United States Patent
McCourt et al.

(10) Patent No.: US 11,629,189 B2
(45) Date of Patent: Apr. 18, 2023

(54) BISPECIFIC ANTIBODY FOR ICOS AND PD-L1

(71) Applicant: KYMAB LIMITED, Cambridge (GB)

(72) Inventors: Matthew John McCourt, Cambridge (GB); Richard Charles Alfred Sainson, Cambridge (GB); Jamie Iain Campbell, Cambridge (GB); Stephen John Arkinstall, Cambridge (GB); Mihriban Tuna, Cambridge (GB); Ryan Fiehler, Cambridge (GB); Mustapha Faroudi, Cambridge (GB); Fadi Badr, Cambridge (GB); Francisca Wollerton Van Horck, Cambridge (GB); Frederick Akele, Cambridge (GB)

(73) Assignee: KYMAB LIMITED, Cambridge (GB)

( * ) Notice: Subject to any disclaimer, the term of this patent is extended or adjusted under 35 U.S.C. 154(b) by 6 days.

(21) Appl. No.: 16/955,219

(22) PCT Filed: Dec. 19, 2018

(86) PCT No.: PCT/GB2018/053698
§ 371 (c)(1),
(2) Date: Jun. 18, 2020

(87) PCT Pub. No.: WO2019/122882
PCT Pub. Date: Jun. 27, 2019

(65) Prior Publication Data
US 2020/0407446 A1    Dec. 31, 2020

Related U.S. Application Data

(60) Provisional application No. 62/607,469, filed on Dec. 19, 2017.

(51) Int. Cl.
*C07K 16/28* (2006.01)
*A61P 35/00* (2006.01)
*A61K 39/00* (2006.01)

(52) U.S. Cl.
CPC .......... *C07K 16/2818* (2013.01); *A61P 35/00* (2018.01); *C07K 16/2827* (2013.01); *A61K 2039/505* (2013.01); *A61K 2039/507* (2013.01); *C07K 2317/21* (2013.01); *C07K 2317/24* (2013.01); *C07K 2317/31* (2013.01); *C07K 2317/526* (2013.01); *C07K 2317/55* (2013.01); *C07K 2317/565* (2013.01); *C07K 2317/72* (2013.01); *C07K 2317/732* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,869,046 A | 2/1999 | Presta et al. |
| 6,121,022 A | 9/2000 | Presta et al. |
| 6,803,039 B2 | 10/2004 | Tsuji et al. |
| 7,030,225 B1 | 4/2006 | Tamatani et al. |
| 7,045,615 B2 | 5/2006 | Tamatani et al. |
| 7,125,551 B2 | 10/2006 | Kroczek |
| 7,132,099 B2 | 11/2006 | Kroczek |
| 7,166,283 B2 | 1/2007 | Tsuji et al. |
| 7,196,175 B2 | 3/2007 | Tamatani et al. |
| 7,226,909 B2 | 6/2007 | Tamatani et al. |
| 7,259,247 B1 | 8/2007 | Kroczek |
| 7,279,560 B2 | 10/2007 | Tamatani et al. |
| 7,306,800 B2 | 12/2007 | Kroczek |
| 7,438,905 B2 | 10/2008 | Suzuki et al. |
| 7,465,445 B2 | 12/2008 | Tezuka et al. |
| 7,722,872 B2 | 5/2010 | Kroczek |
| 7,794,710 B2 | 9/2010 | Chen et al. |
| 7,892,540 B2 | 2/2011 | Chen et al. |
| 7,932,358 B2 | 4/2011 | Tamatani et al. |
| 7,988,965 B2 | 8/2011 | Tsuji et al. |
| 7,998,478 B2 | 8/2011 | Tezuka et al. |
| 8,168,179 B2 | 5/2012 | Honjo et al. |
| 8,318,905 B2 | 11/2012 | Kroczek |
| 8,389,690 B2 | 3/2013 | Tamatani et al. |
| 8,840,889 B2 | 9/2014 | Chen |
| 8,916,155 B2 | 12/2014 | Kroczek |
| 9,102,725 B2 | 8/2015 | Korman et al. |
| 9,376,493 B2 | 6/2016 | Faget et al. |

(Continued)

FOREIGN PATENT DOCUMENTS

| | | |
|---|---|---|
| CN | 110579836 B | 10/2020 |
| EP | 0984023 A1 | 3/2000 |

(Continued)

OTHER PUBLICATIONS

Abcam Product Datasheet, Anti-ICOS antibody [C398.4A) ab81459, 2 pages.
Abiko et al., "PD-L 1 on tumor cells is induced in ascites and promotes peritoneal dissemination of ovarian cancer through CTL dysfunction", Clin Cancer Res, 19(6):1363-74 (2013).
Affymetrix eBioscience, Anti-Human CD278 (ICOS) Purified, 1 page.
Alexandrov et al. "Signatures of mutational processes in human cancer." Nature. Aug. 22, 2013;500(7463):415-21.
Barbie, et al., "Systematic RNA interference reveals that oncogenic KRAS-driven cancers require TBK1." Nature, 2009; 462(7269)108-12, plus 22 pages supplemental materials.

(Continued)

*Primary Examiner* — Ilia I Ouspenski
(74) *Attorney, Agent, or Firm* — Lathrop GPM LLP; James H. Velema, Esq.

(57) ABSTRACT

Multispecific antibody in mAb2 format, comprising an ICOS-binding Fab region and a PD-L1-binding Fcab region. Use of the multispecific antibody in immuno-oncology, including for treatment of solid tumours. Combination therapy including antibody to another immune checkpoint molecule such as PD-1 and CTLA-4, in addition to anti-ICOS and anti-PD-L1.

27 Claims, 44 Drawing Sheets

Specification includes a Sequence Listing.

(56) References Cited

U.S. PATENT DOCUMENTS

| | | | |
|---|---|---|---|
| 9,567,399 | B1 | 2/2017 | Campbell et al. |
| 9,617,338 | B1 | 4/2017 | Campbell et al. |
| 9,810,837 | B2 | 11/2017 | Benabid et al. |
| 9,957,323 | B2 * | 5/2018 | Sainson ............... C07K 16/28 |
| 10,266,608 | B2 | 4/2019 | Wu |
| 10,517,949 | B2 | 12/2019 | Wang |
| 2002/0156242 | A1 | 10/2002 | Tamatani et al. |
| 2003/0124149 | A1 | 7/2003 | Shalaby et al. |
| 2005/0085433 | A1 | 4/2005 | Breidenstein et al. |
| 2006/0002929 | A1 | 1/2006 | Khare et al. |
| 2007/0122378 | A1 | 5/2007 | Freeman et al. |
| 2008/0069795 | A1 | 3/2008 | Rabb |
| 2009/0055944 | A1 | 2/2009 | Korman et al. |
| 2010/0166740 | A1 | 7/2010 | Endl et al. |
| 2010/0203056 | A1 | 8/2010 | Irving et al. |
| 2011/0065902 | A1 | 3/2011 | Sleeman et al. |
| 2015/0239978 | A1 | 8/2015 | Marodon et al. |
| 2015/0307620 | A1 | 10/2015 | Vella et al. |
| 2016/0002336 | A1 | 1/2016 | Chen |
| 2016/0024211 | A1 | 1/2016 | Chen |
| 2016/0145344 | A1 | 5/2016 | Akbari |
| 2016/0215059 | A1 | 7/2016 | Liu et al. |
| 2016/0264666 | A1 | 9/2016 | Faget et al. |
| 2016/0304610 | A1 | 10/2016 | Sazinsky et al. |
| 2019/0202917 | A1 * | 7/2019 | Campbell ........... C07K 16/2827 |
| 2019/0330345 | A1 | 10/2019 | Sainson et al. |
| 2019/0338032 | A1 | 11/2019 | Campbell |
| 2020/0131267 | A1 | 4/2020 | Carvalho |
| 2020/0190191 | A1 * | 6/2020 | Campbell ............... A61P 35/00 |
| 2020/0317786 | A1 | 10/2020 | Labokha |
| 2020/0407446 | A1 | 12/2020 | McCourt |
| 2021/0139590 | A1 * | 5/2021 | Tuna ................... C07K 16/2827 |
| 2021/0380699 | A1 | 12/2021 | Campbell |

FOREIGN PATENT DOCUMENTS

| | | |
|---|---|---|
| EP | 1125585 A1 | 8/2001 |
| EP | 1158004 A2 | 11/2001 |
| EP | 1374901 A1 | 1/2004 |
| EP | 1502920 A2 | 2/2005 |
| EP | 1286668 B1 | 4/2005 |
| EP | 1740617 B1 | 10/2013 |
| EP | 2691419 B1 | 11/2016 |
| EP | 2482849 B1 | 6/2018 |
| FR | 3006774 A1 | 12/2014 |
| GB | 2583352 A | 10/2020 |
| JP | 2013-506690 A | 2/2013 |
| RU | 2540490 C2 | 2/2015 |
| WO | WO-1998/003821 A2 | 1/1998 |
| WO | WO-1999/015553 A2 | 4/1999 |
| WO | WO-2001/014424 A2 | 3/2001 |
| WO | WO 2001/077342 A1 | 10/2001 |
| WO | WO-2001/087981 A2 | 11/2001 |
| WO | WO-2005/103086 A1 | 11/2005 |
| WO | WO-2006/133396 A2 | 12/2006 |
| WO | WO-2007/005874 A2 | 1/2007 |
| WO | WO-2007/113648 A2 | 10/2007 |
| WO | WO-2007/133290 A2 | 11/2007 |
| WO | WO 2008/003103 A2 | 1/2008 |
| WO | WO-2008/083174 A2 | 7/2008 |
| WO | WO-2008/137915 A2 | 11/2008 |
| WO | WO-2009/070642 A1 | 6/2009 |
| WO | WO-2009/126688 A2 | 10/2009 |
| WO | WO-2009/141239 A1 | 11/2009 |
| WO | WO-2010/036959 A2 | 4/2010 |
| WO | WO-2010/056804 A1 | 5/2010 |
| WO | WO-2010/077634 A1 | 7/2010 |
| WO | WO-2010/089411 A2 | 8/2010 |
| WO | WO-2011/004192 A1 | 1/2011 |
| WO | WO-2011/020024 A2 | 2/2011 |
| WO | WO-2011/041613 A2 | 4/2011 |
| WO | WO-2011/066389 A1 | 6/2011 |
| WO | WO-2011/071871 A1 | 6/2011 |
| WO | WO-2011/073180 A1 | 6/2011 |
| WO | WO-2011/097477 A1 | 8/2011 |
| WO | WO-2011/158009 A1 | 12/2011 |
| WO | WO-2012/131004 A2 | 10/2012 |
| WO | WO-2012/145493 A1 | 10/2012 |
| WO | WO-2012/174338 A2 | 12/2012 |
| WO | WO-2013/061078 A1 | 5/2013 |
| WO | WO-2013/061098 A2 | 5/2013 |
| WO | WO-2013/079174 A1 | 6/2013 |
| WO | WO-2013/173223 A1 | 11/2013 |
| WO | WO-2013/181634 A2 | 12/2013 |
| WO | WO-2014/033327 A1 | 3/2014 |
| WO | WO-2014/055897 A2 | 4/2014 |
| WO | WO-2014/089113 A1 | 6/2014 |
| WO | WO-2014/100079 A1 | 6/2014 |
| WO | WO-2014/116846 A2 | 7/2014 |
| WO | WO-2014/159562 A1 | 10/2014 |
| WO | WO-2014/165082 A2 | 10/2014 |
| WO | WO-2015/040401 A1 | 3/2015 |
| WO | WO-2015/049537 A1 | 4/2015 |
| WO | WO-2015/061668 A1 | 4/2015 |
| WO | WO 2015/103072 A1 | 7/2015 |
| WO | WO-2015/109124 A2 | 7/2015 |
| WO | WO-2015/112800 A1 | 7/2015 |
| WO | WO-2015/112805 A1 | 7/2015 |
| WO | WO-2015/112900 A1 | 7/2015 |
| WO | WO-2015/132580 A1 | 9/2015 |
| WO | WO-2015/136541 A2 | 9/2015 |
| WO | WO-2015/173267 A1 | 11/2015 |
| WO | WO-2015/179654 A1 | 11/2015 |
| WO | WO-2015/181342 A1 | 12/2015 |
| WO | WO-2016/000619 A1 | 1/2016 |
| WO | WO-2016/007235 A1 | 1/2016 |
| WO | WO-2016/022630 A1 | 2/2016 |
| WO | WO-2016/028656 A1 | 2/2016 |
| WO | WO-2016/030350 A1 | 3/2016 |
| WO | WO-2016/061142 A1 | 4/2016 |
| WO | WO-2016/068801 A1 | 5/2016 |
| WO | WO-2016/106302 A1 | 6/2016 |
| WO | WO-2016/111645 A1 | 7/2016 |
| WO | WO-2016/120789 A1 | 8/2016 |
| WO | WO-2016/149201 A2 | 9/2016 |
| WO | WO-2016/154177 A2 | 9/2016 |
| WO | WO-2016/160792 A1 | 10/2016 |
| WO | WO-2016/191643 A2 | 12/2016 |
| WO | WO-2016/197367 A1 | 12/2016 |
| WO | WO-2017/020291 A1 | 2/2017 |
| WO | WO-2017/020801 A1 | 2/2017 |
| WO | WO-2017/020858 A1 | 2/2017 |
| WO | WO-2017/025871 A1 | 2/2017 |
| WO | WO-2017/030823 A2 | 2/2017 |
| WO | WO-2017/034916 A1 | 3/2017 |
| WO | WO-2017/037707 A1 | 3/2017 |
| WO | WO-2017/053748 A2 | 3/2017 |
| WO | WO-2017/059095 A1 | 4/2017 |
| WO | WO-2017/070423 A1 | 4/2017 |
| WO | WO-2017/087587 A1 | 5/2017 |
| WO | WO-2017/213695 A1 | 12/2017 |
| WO | WO-2017/220988 A1 | 12/2017 |
| WO | WO-2018/025221 A1 | 2/2018 |
| WO | WO 2018/029474 A2 | 2/2018 |
| WO | WO-2018/045110 A1 | 3/2018 |
| WO | WO 2018/047178 | 3/2018 |
| WO | WO-2018/085358 A1 | 5/2018 |
| WO | WO-2018/115859 A1 | 6/2018 |
| WO | WO-2018/187191 A1 | 10/2018 |
| WO | WO-2018/187613 A1 | 10/2018 |
| WO | WO-2018/225033 A1 | 12/2018 |
| WO | WO-2019/121906 A1 | 6/2019 |
| WO | WO 2019/122882 A1 | 6/2019 |
| WO | WO 2019/122884 A1 | 6/2019 |
| WO | WO 2021/043961 A1 | 3/2021 |

OTHER PUBLICATIONS

Baruch et al. "PD-1 immune checkpoint blockade reduces pathology and improves memory in mouse models of Alzheimer's disease." Nat Med, 2016; 22(2):135-9, plus 296 pages supplemental material.

(56) References Cited

OTHER PUBLICATIONS

Beer et al., "Randomized, Double-Blind, Phase III Trial of Ipilimumab Versus Placebo in Asymptomatic or Minimally Symptomatic Patients with Metastatic Chemotherapy-Naïve Castration-Resistant Prostate Cancer," Journal of Clinical Oncology, 35(1): 40-51 (2019).
Beier et al. "Induction, binding specificity and function of human ICOS." Eur J Immunol. Dec. 2000;30(12):3707-17.
Binnewies et al., "Understanding the tumor immune microenvironment (TIME) for effective therapy," Nature Medicine, Published online Apr. 23, 2018 (10 pages).
Blank et al., "PD-L1/B7H-1 inhibits the effector phase of tumor rejection by T cell receptor (TCR) transgenic COB+ T cells" 64(3):1140-5 (2004).
Bos et al., "Transient regulatory T cell ablation deters oncogene-driven breast cancer and enhances radiotherapy," J Exp Med 210(11):2434-2446 2013.
Boschetti et al., "Therapy with Anti-TNFα Antibody Enhances Number and Function of FOXP3+ Regulatory T Cells in Inflammatory Bowel Diseases," AGA Abstracts, S-743 (2010).
Brahmer et al., "Phase I study of single-agent anti-programmed death-1 (MDX-1106) in refractory solid tumors: safety, clinical activity, pharmacodynamics, and immunologic correlates", J Clin Oncol, 28(19):3167-75 (2010).
Brahmer et al., "Safety and activity of anti-PD-L 1 antibody in patients with advanced cancer", N Engl J Med, 366 (26):2455-65 (2012).
Briskin, "Efficacy of Anti-ICOS Agonist Monoclonal Antibodies in Preclinical Models Provides a Rationale for Clinical Development for cancer immunotherapy," Presentation SITC 2015, 22 pages.
Brown et al., "Blockade of programmed death-1 ligands on dendritic cells enhances T cell activation and cytokine production", J Immunol, 170(3):1257-66 (2003).
Buonfiglio et al., "The T cell activation molecule H4 and the CD28-like molecule ICOS are identical," Eur. J. Immunol., 30:3463-3467 (2000).
Burmeister et al., "ICOS Controls the Pool Size of Effector-Memory and Regulatory T Cells," J. Immunol., 180(2): 774-782 (2008).
Burris III et al., "Phase 1 Safety of ICOS Agonist Antibody JTX-2011 Alone and with Nivolumab (Nivo) in Advanced Solid Tumors; Predicted vs. Observed Pharmacokinetics (PK) in ICONIC" (2017).
Butte et al., "Programmed death-1 ligand 1 interacts specifically with the B7-1 costimulatory molecule to inhibit T cell responses", Immunity, 27(1):111-22 (2007).
Camus et al., "Coordination of Intratumoral Immune Reaction and Human Colorectal Cancer Recurrence," Cancer Res 69:2685-93 (2009).
Carthon et al. Preoperative CTLA-4 blockade: Tolerability and immune monitoring in the setting of a presurgical clinical trial. Clin. Cancer Res. 16:2861-2871.
Chattopadhyay et al., "Structural Basis of Inducible Costimulatory Ligand Function: Determination of the Cell Surface Oligomeric State and Functional Mapping of the Receptor Binding Site of the Protein," J. Immunol. 177(6):3920-3929 2006.
Chevalier et al., "Phenotype Alterations in Regulatory T-Cell Subsets in Primary HIV Infection and Identification of Tr1-like Cells at the Main Interleukin 10-Producing CD4+ T Cells," JID, 211: 769-779 (2015).
Collin, "Immune checkpoint inhibitors: a patent review" Expert Opinion on Therapeutic Patents, 26(5): 555-564 (2016).
Conrad et al., "Plasmacytoid dendritic cells and regulatory T cells in the tumor microenvironment: A dangerous liaison." Oncoimmunology. May 1, 2013;2(5):e2388.
Coyle et al. "The CD28-related molecule ICOS is required for effective T cell-dependent immune responses." Immunity. Jul. 2000;13(1):95-105.
Crotty, "T follicular helper cell differentiation, function, and roles in disease." Immunity. Oct. 16, 2014;41(4):529-42.
Curran et al., "PD-1 and CTLA-4 combination blockade expands infiltrating cells and reduces regulatory T and myeloid cells within B16 melanoma tumors", PNAS, 107(9): 4275-4280 (2010).
Currie et al. "Dual Control of Antitumor CD8 T Cells through the Programmed Death-1/Programmed Death-Ligand 1 Pathway and Immunosuppressive CD4 T Cells: Regulation and Counterregulation," J. Immunol., 183(12): 7898-7908 (2009).
Dall et al., "Increasing the affinity of a human IgG1 for the neonatal Fc receptor : Biological consequences." Immunol 2002; 169:5171-5180.
Dana Farber Blog, "Enhancing Immunotherapy: The Race to Make 'Cold' Tumors 'Hot,'" Published Jun. 6, 2018 at https://blog.dana.farber.org/insight/2018/06/enhancing-immunotherapy-race-make-cold-tumors-hot/ (7 pages).
Declaration of Dr. Anil K. Thotakura submitted with Statement of Opposition filed at European Patent Office against European Patent No. EP2482849 on Mar. 6, 2019 (27 pages).
Declaration of Dr. Gwenoline Borhis submitted with Statement of Opposition filed at European Patent Office against European Patent No. EP2482849 on Mar. 6, 2019 (10 pages).
Declaration of Dr. Richard C.A. Sainson, submitted with Statement of Opposition filed at European Patent Office against European Patent No. EP2482849 on Mar. 6, 2019 (8 pages).
Deng et al., "An Agonist Human ICOS Monoclonal Antibody that Induces T Cell Activation and Inhibits Proliferation of a Myeloma Cell Line," Hybridoma and Hybridomics, 23(3): 176-182 (2004).
Deng et al., "Extrafollicular CD4+ T-B interactions are sufficient for inducing autoimmune-like chronic graft-versus-host disease," Nature Communications 2017, 18:978, (17 pages).
Dong et al., "B7-H1, a third member of the B7 family, co-stimulates T-cell proliferation and interleukin-10 secretion" Nat Med, 5(12):1365-9 (1999).
Dong et al. "ICOS co-stimulatory receptor is essential for T-cell activation and function." Nature. 2001; 409(6816):97-101.
Dong et al., "Tumor-associated B7-H1 promotes T-cell apoptosis: a potential mechanism of immune evasion", Nat Med, 8(8):793-800 (2002).
Dranoff et al., "Vaccination with irradiated tumor cells engineered to secrete murine granulocyte-macrophage colony-stimulating factor stimulates potent, specific, and long-lasting anti-tumor immunity," Proc. Natl. Acad. Sci. USA 90: 3539-3543 (1993).
Driessens et al., "Costimulatory and coinhibitory receptors in anti-tumor immunity," Immunol. Rev. 229(1) : 126-144 (2009).
Eager et al., "GM-CSF Gene-Transduced Tumor Vaccines," Molecular Therapy 12(1): 18-27 (2005).
Elpek et al., "Abstract A059: Efficacy of anti-ICOS agonist monoclonal antibodies in preclinical tumor models proves a rationale for clinical development as cancer immunotherapeutics," Cancer Immunology Research, (2016).
EuropeanBiotechnology.com, "Roche's anti-PD-L1 fails in bladder cancer," Published May 10, 2017 at https://european-biotechnology.com/up-to-date/latest-news/news/roches-anti-pd-l1-fails-in-bladder-cancer.html (2 pages).
Faget et al., "ICOS-Ligand Expression on Plasmacytoid Dendritic Cells Supports Breast Cancer Progression by Promoting the Accumulation of Immunosuppressive CD4+ T Cells," Cancer Res., 72(23): (2012).
Fan et al. "Engagement of the ICOS pathway markedly enhances efficacy of CTLA-4 blockade in cancer immunotherapy." J Exp Med. Apr. 7, 2014;211(4):715-25.
Fehrenbacher et al., "Atezolizumab versus docetaxel for patients with previously treated non-small-cell lung cancer (POPLAR): a multicentre, open-label, phase 2 randomised controlled trial", Lancet, 387(10030):1837-46 (2016).
Feyler et al., "Tumour Cell Generation of Inducible Regulatory T-Cells in Multiple Myeloma is Contact-Dependent and Antigen-Presenting Cell-Independent," PLoS ONE, 7(5): 10 pages (2012).
Francisco et al., "PD-L1 regulates the development, maintenance, and function of induced regulatory T cells," J. Exp. Med. 206(13): 3015-3029 (2009).
Freeman et al., "Engagement of the PD-1 immunoinhibitory receptor by a novel B7 family member leads to negative regulation of lymphocyte activation", J Exp Med, 192(7): 1027-34 (2000).

(56) References Cited

OTHER PUBLICATIONS

French et al., "What is conservative substitution?" J. Mol. Evol. 1983; 19;171-5.
Fu et al., "The ICOS/ICOSL pathway is required for optimal antitumor responses mediated by anti-CTLA-4 therapy." Cancer Res. Aug. 15, 2011;71(16):5445-54.
Galluzzi et al., "Immunological mechanisms underneath the efficacy of cancer therapy." Canc. Imm. Res. 4:895-902 (2016).
Galon et al., "Approaches to treat immune hot, altered and cold tumours with combination immunotherapies," Nature Reviews Drug Discovery, Published online Jan. 4, 2019 (22 pages).
Gerritsen et al., "A dose-escalation trial of GM-CSF-gene transduced allogeneic prostate cancer cellular immunotherapy in combination with a fully human anti-CTLA antibody (MDX-010, ipilimumab) in patients with metastatic hormone-refractory prostate cancer (mHRPC)" Journal of Clinical Oncology, 24(18), Published online Dec. 12, 2016 at http://ascopubs.org/doi/abs/10.1200/jco.2006.24.18_suppl. 2500 (5 pages).
Hamada et al., "Carrier Cell-mediated Delivery of a Replication-competent Adenovirus for Cancer Gene Therapy," Molecular Therapy 15(6): 1121-1128 (2007).
Hanzelmann, et al., "GSVA: gene set variation analysis for microarray and RNA-Seq data," BMC Bioinformatics, vol. 14, No. 1, p. 7, 2013.
Harvey et al., "Efficacy of Anti-ICOS Agonist Monoclonal Antibodies in Preclinical Models Provides a Rationale for Clinical Development for cancer immunotherapy," Journal for Immunotherapy of Cancer 3(Suppl 2):O9 (2015).
Hasenhindl et al., "Creating stable stem regions for loop elongation in Fcabs—Insights from combining yeast surface display, in silico loop reconstruction and molecular dynamics simulations", Biochimica et Biophysica Acta 1844: 1530-1540 (2014).
Helfand, "AstraZeneca's Imfinzi fails key Mystic trial in lung cancer. What now?" Published online Nov. 16, 2018 at https://www.fiercepharma.com/pharma/astrazeneca-s-imfinzi-fails-key-mystic-trial-lung-cancer-what-now (4 pages).
Herbst et al., "Predictive correlates of response to the anti-PD-L 1 antibody MPDL3280A in cancer patients", Nature, 515(7528):563-7 (2014).
Hirano et al., "Blockade of B7-H1 and PD-1 by monoclonal antibodies potentiates cancer therapeutic immunity", Cancer Res, 65(3):1089-96 (2005).
Hirsch et al., "Biomarker Driven Indication Selection in JTX-2011 ICONIC Clinical Trial," poster presented at the American Society of Clinical Oncology (ASCO) Annual Meeting, Jun. 2-6, 2017 in Chicago, Illinois.
Hirsch, "A biomarker-driven approach for the development of the ICOS agonist antibody, JTX-2011, presentation for the Society for Immunotherapy of Cancer," Nov. 8, 2017 in National Harbor, Maryland, 11 pages.
Hodge et al., "Multiple Costimulatory Modalities Enhance CTL Avidity," J. Immunol. 174: 5994-6004 (2005).
Hodi et al., "Immunologic and clinical effects of antibody blockade of cytotoxic T lymphocyte-associated antigen 4 in previously vaccinated cancer patients." PNAS Feb. 26, 2008;105(8):3005-10.
Houot et al., "Therapeutic effect of CD137 immunomodulation in lymphoma and its enhancement by Treg depletion," Blood 114:3431-3438 2009.
Hutloff et al. "ICOS is an inducible T-cell co-stimulator structurally and functionally related to CD28." Nature. 1999; 397(6716):263-6.
Idusogie et al., "Engineered antibodies with increased activity to recruit complement." J. Immunol., 2001, 166:2571-2575.
Inman, "Costimulation, Coinhibition, and Cancer." Current Cancer Drug Targets, 7, 15-30 (2007).
International Search Report & Written Opinion dated Sep. 22, 2017; PCT/GB2017/051794.
International Search Report & Written Opinion dated Sep. 25, 2017; PCT/GB2017/051795.
International Search Report & Written Opinion dated Oct. 4, 2017; PCT/GB2017/051796.
International Search Report & Written Opinion dated Feb. 5, 2018; PCT/GB2017/052352.
International Search Report & Written Opinion dated May 3, 2018; PCT/GB2017/053826.
International Search Report & Written Opinion dated May 7, 2019; PCT/GB2018/051714.
International Search Report & Written Opinion dated Apr. 1, 2019, PCT/GB2018/053698.
International Search Report & Written Opinion dated May 27, 2019, PCT/GB2018/053701.
Iwai et al., "Involvement of PD-L1 on tumor cells in the escape from host immune system and tumor immunotherapy by PD-L 1 blockade", Proc Natl Acad Sci USA, 99(19):12293-7 (2002).
Janke et al., "Eminent role of ICOS costimulation for T cells interacting with plasmacytoid dendritic cells," Immunology, 11: 353-360 (2006).
Jian-Fei Tu et al., "Regulatory T cells, especially ICOS+ FOXP3(+) regulatory T cells, are increased in the hepatocellular carcinoma microenvironment and predict reduced survival", Scientific Reports, vol. 6, Oct. 2016.
Jounce Therapeutics, "Advancing Cancer Immunotherapy Worldwide" Presentation for SITC Conference, Nov. 8-12, 2017.
Jounce Therapeutics Press Release, Jounce Therapeutics Initiates Phase 2 Portion of ICONIC Study of JTX-2011 in Patients with Advanced Solid Tumors, Apr. 20, 2017, 3 pages.
Jounce Therapeutics Press Release, Jounce Therapeutics Initiates Phase 1/2 ICONIC Study of JTX-2011 in Patients with Advanced Solid Tumors, Sep. 7, 2016, 2 pages.
Jounce Therapeutics Press Release, Jounce Therapeutics Presents Data Highlighting Advances From Two Programs in its Immuno-Oncology Pipeline at the 2016 AACR Annual Meeting, Apr. 17, 2016, 2 pages.
Jounce Therapeutics Press Release, Jounce Therapeutics Presents Phase 1 Data from ICONIC Study of JTX-2011 in Patients with Advanced Solid Tumors at 2017 ASCO Annual Meeting, Jun. 5, 2017, 6 pages.
Jounce Therapeutics Press Release, Jounce Therapeutics to Present Program Updates at AACR Annual Meeting 2016, Mar. 16, 2016, 2 pages.
Jounce Therapeutics Press Release, Jounce Therapeutics to Present at AACR Annual Meeting on JTX-2011 Cancer Immunotherapy Program, Mar. 22, 2017, 5 pages.
Jounce Therapeutics Press Release, Jounce Therapeutics to Present Phase 1 Data from JTX-2011 ICONIC Trial at 2017 American Society of Clinical Oncology Annual Meeting, May 17, 2017, 5 pages.
Kaiser et al., "Reduced tumor-antigen density leads to PD-1/PD-L 1-mediated impairment of partially exhausted COB+ T cells", Eur J Immunol, 42(3):662-71 (2012).
Keir et al., "PD-1 and Its Ligands in Tolerance and Immunity," Annu. Rev. Immunol. 26: 677-704 (2008).
Kilpatrick et al., "Rapid development of affinity matured monoclonal antibodies using RIMMS;" Hybridoma, 1997; 16(4):381-9.
Kraman et al. "A LAG-3/PD-L1 bispecific antibody inhibits tumour growth in two syngeneic colon carcinoma patients," Keystone Symposium, 2017, Poster 3005.
Kroemer et al. "Immunologic Cell Death in Cancer Therapy," Ann Rev Immunol. 2013; 31:51-72.
Langer, "New methods of drug delivery." (1990) Science 249:1527-1533.
Lazar et al., "Engineered antibody Fc variants with enhanced effector function," 2006, Proc. Natl. Acad. Sci. U.S.A., Mar. 14; 103(11):4005-10.
Le et al., "Follicular B Lymphomas Generate Regulatory T Cells via the ICOS/ICOSL Pathway and Are Susceptible to Treatment by Anti-ICOS/ICOSL Therapy," Cancer Res., 76(16):4648-4660 (2016).
Lee et al., "Complete humanization of the mouse immunoglobulin loci enables efficient therapeutic antibody discovery." Nature Biotechnology, 2014; 32:6-363.
Lefranc "IMGT unique numbering for immunoglobulin and T cell receptor variable domains and Ig superfamily V-like domains," Dev Comp Immunol. 2003; 27(1):55-77.

(56) References Cited

OTHER PUBLICATIONS

Liakou et al. "CTLA-4 blockade increases IFNgamma-producing CD4+ICOShi cells to shift the ratio of effector to regulatory T cells in cancer patients." Proc Natl Acad Sci U S A. Sep. 30, 2008;105(39):14987-92.
Lin et al., "The PD-1/PD-L1 complex resembles the antigen-binding Fv domains of antibodies and T cell receptors", Proc Natl Acad Sci USA, 105(8):3011-6 (2008).
Liston et al., "Dicer-dependent microRNA pathway safeguards regulatory T cell function," J Exp Med 205(9): 1993-2004 (2008).
Löhning et al., "Expression of ICOS in Vivo Defines CD4+ Effector T Cells with High Inflammatory Potential and a Strong Bias for Secretion of Interleukin 10," J. Exp. Med., 197(2): 181-193 (2003).
Mak et al.. "Costimulation through the inducible costimulator ligand is essential for both T helper and B cell functions in T cell-dependent B cell responses." Nat Immunol. 2003; 4(8):765-72.
Martin-Orozco et al., "Melanoma Cells Express ICOS Ligand to Promote the Activation and Expansion of T-Regulatory Cells," Cancer Research 70(23):9581-9590 2010.
McAdam et al., "Mouse Inducible Costimulatory Molecule (ICOS) Expression is Enhanced by CD28 Costimulation and Regulates Differentiation of CD4+ T Cells," J. Immunology, 165:5035-5040 (2000).
McCourt et al., "KY1055, a novel anti-ICOS/PD-L1 bispecific antibody, enhances T cell activation and delivers potent monotherapy anti-tumour responses in vivo," poster, 1 page.
McCourt et al., "KY1055, a novel anti-ICOS/PD-L1 bispecific antibody, enhances T cell activation and delivers potent monotherapy anti-tumour responses in vivo," PowerPoint, 13 pages.
Metzger et al., "ICOS Promotes the Function of CD4+ Effector T Cells during Anti-OX40-Mediated Tumor Rejection," Cancer Res, 76(13): 3684-3689 (2016).
Michaelson, "Preclinical Assessment of JTX-2011, An Agonist Antibody Targeting ICOS, Supports Evaluation in ICONIC Clinical Trial," Presentation 2017, 27 pages.
Moore et al., "Anti-PD1 x anti-ICOS bispecific antibody XmAb23104 brings together PD1 blockade and ICOS costimulation to promote human T cell activation and proliferation" SITC 2017 Poster P347.
Moynihan et al., "Eradication of large established tumors in mice by combination immunotherapy that engages innate and adaptive immune responses," Nature Medicine, 12 pages (2016).
Nair et al., "A simple practice guide for dose conversion between animals and human." J Basic Clin Pharma 2016;7:27-31.
Natsume et al., "Engineered Antibodies of IgG1/IgG3 Mixed Isotype with Enhanced Cytotoxic Activities." Cancer Res., 68: 3863-3872.
Natsume et al., "Improving effector functions of antibodies for cancer treatment : Enhancing ADCC and CDC," 2009, Drug Des. Devel. Then, 3:7-16.
Nemunaitis, "Vaccines in Cancer: GVAX®, a GM-CSF gene vaccine," Expert Rev. Vaccines 4(3): 259-274 (2005).
Neri et al., "Immunocytokines for cancer treatment: past, present and future", Current Opinion in Immunology, Elsevier, Oxford, GB vol. 40, Apr. 6, 2016 (Apr. 6, 2016), pp. 96-102.
Odegard et al., "ICOS Controls Effector Function but Not Trafficking Receptor Expression of Kidney-Infiltrating Effector T Cells in Murine Lupus," J Immunology 182:4076-84 (2009).
Ohaegbulam et al., "Human cancer immunotherapy with antibodies to the PD-1 and PD-L1 pathway," Trends Mol Med., 21(1): 24-33, 23 pages (2014).
Powell et al. "Compendium of excipients for parenteral formulations" PDA J Pharm Sci Technol, 1998; 52:238-311.
Preston, et al., "The ratios of CD8+ T cells to CD4+CD25+ FOXP3+ and FOXP3− T cells correlate with poor clinical outcome in human serous ovarian cancer." PLoS One Nov. 14;8(11):e80063 (2013).
Pühler et al., "Generation of a recombinant oncolytic Newcastle disease virus and expression of a full IgG antibody from two transgenes," Gene Ther. 15: 371-383 (2008).

Quezada et al., "CTLA4 blockade and GM-CSF combination immunotherapy alters the intratumor balance of effector and regulatory T cells," Journal of Clinical Investigation, 116(7): 1935-45 (2006).
Redoglia et al., "Characterization of H4: a mouse T Lymphocyte activation molecule functionally associated with the DC3/T cell receptor," Eur. J. Immunol., 11: 2781-9 ( 1996) (abstract only).
Rosenberg et al., "Atezolizumab in patients with locally advanced and metastatic urothelial carcinoma who have regressed following treatment with platinum-based chemotherapy: a single-arm, multicentre, phase 2 trial", Lancet, 387(10031):1909-20 (2016).
Rossi et al., "Optimization of multivalent bispecific antibodies and immunocytokines with improved in vivo properties", Bioconjug Chem, 24(1):63-71 (2013).
Rubio, et al. "Ex vivo identification, isolation and analysis of tumor-cytolytic T cells." Nat Med. 2003;9(11):1377-82, plus 9 pages supplemental material.
Rudikoff et al., "Single Amino Acid Substitution Altering Antigen-Binding Specificity," Proc. Natl. Acad. Sci., 79: 1978-1983 (1982).
Sainson et al., "KY1044, a novel anti-ICOS antibody, elicits long term in vivo anti-tumour efficacy as monotherapy and in combination with immune checkpoint inhibitors", 1 page.
Sainson et al., "KY1055, a novel ICOS/PD-L1 bispecific antibody, efficiently enhances T cell activation and delivers a potent anti-tumour response in vivo", 1 page.
Sainson et al., "A novel antibody targeting ICOS increases intratumoural cytotoxic to regulatory T cell ratio and induces tumour regression," bioRxiv preprint first posted online Sep. 16, 2019, https://www.biorxiv.org/content/biorxiv/early/2019/09/16/771493.full.pdf—Retrieved Oct. 21, 2019 (80 pages).
Sanmamed et al., "Agonists of Co-stimulation in Cancer Immunotherapy Directed Against CD137, OX40, GITR, CD27, CD28, and ICOS," Seminars in Oncology, 42(4): 640-655 (2015).
Sato et al., "Spatially selective depletion of tumor-associated regulatory T cells with near-infrared photoimmunotherapy," Science Translational Medicine, 2016; 8(352):1-12, plus 27 pages supplemental material.
Sears et al., "ICONIC: Phase 1/2 Trial of ICOS Agonist JTX-2011 Alone and in Combination with Nivolumab (nivo)" (2017).
Selby et al., "Anti-CTLA-4 antibodies of IgG2a isotype enhance antitumor activity through reduction of intratumoral regulatory T cells." Cancer immunology research, 1(1):32-42 2013.
Sharma et al., "Immune Checkpoint Targeting in Cancer Therapy: Toward Combination Strategies with Curative Potential," Cell, 161: 205-214 (2015).
Shields et al., "High resolution mapping of the binding site on human IgG1 for Fc gamma RI, Fc gamma RII, Fc gamma RIII, and FcRn and design of IgG1 variants with improved binding to the Fc gamma R." 2001, J. Biol. Chem., Mar. 2; 276(9):6591-604).
Shields et al. "Lack of Fucose on Human IgG1 N-Linked Oligosaccharide Improves Binding to Human FcγRIII and Antibody-dependent Cellular Toxicity" (2002) JBC 277:26733.
Shirakawa, "The Current Status of Adenovirus-based Cancer Gene Therapy," Mol. Cells, 25(4): 462-466 (2008).
Sim et al., "IL-2 therapy promotes suppressive ICOS+ Treg expansion in melanoma patients," J Clin Invest, 124(1): 99-110 (2014).
Sim et al., "IL-2 variant circumvents ICOS+ regulatory T cell expansion and promotes NK cell activation," Cancer Immunol Res 2016.
Simpson et al., "Regulation of CD4 T cell activation and effector function by inducible costimulatory (ICOS)," Current Opinion in Immunology 22: 326-332 (2010).
Simpson et al., "Fc-dependent depletion of tumor-infiltrating regulatory T cells co-defines the efficacy of anti-CTLA-4 therapy against melanoma." J. Exp. Med. 210(9):1695-1710 2013.
Solomon et al., "TIGIT: a novel immunotherapy target moving from bench to bedside," Cancer Immunol Immunother; 67(11):1659-1667 (2018).
Song et al., "Overexpression of B7-H1 correlates with malignant cell proliferation in pancreatic cancer", Oncol Rep, 31(3):1191-8 (2014).
Statement of Opposition filed at European Patent Office against European Patent No. EP2482849 on Mar. 6, 2019 (62 pages).

(56) References Cited

OTHER PUBLICATIONS

Strauss et al., "Expression of ICOS on Human Melanoma-Infiltrating CD4+CD25$^{high}$Foxp3+ T Regulatory Cells: Implications and Impact on Tumor-Mediated Immune Suppression," J. Immunol 180(5): 2967-2980 (2008).
Swallow et al., "B7h, a novel costimulatory homolog of B7.1 and B7.2, is induced by TNFalpha." Immunity. Oct. 1999;11(4):423-32.
Thompson et al., "Tumor B7-H1 is associated with poor prognosis in renal cell carcinoma patients with long-term follow-up", Cancer Res, 66(7):3381-5 (2006).
Topalian et al., "Safety, activity, and immune correlates of anti-PD-1 antibody in cancer", N Engl J Med, 366(26):2443-54 (2012).
Tu et al., "Regulatory T cells, especially ICOS FOXP3+ regulatory T cells, are increased in the hepatocellular carcinoma microenvironment and predict reduced survival," Scientific Reports, 6:35056 (2016).
Ueha et al., "Robust Antitumor Effects of Combined Anti-CD4-Depleting Antibody and Anti-PD-1/PD-LI Immune Checkpoint Antibody Treatment in Mice," Cancer Immunology Research, 3(6); pp. 631-640 (2015).
U.S. National Library of Medicine, "Anti-ICOS Monoclonal Antibody MEDI-570 in Treating Patients with Relapsed or Refractory Peripheral T-cell Lymphoma Follicular Variant or Angioimmunoblastic T-cell Lymphoma," ClinicalTrials.gov Identifier No. NCT02520791. First posted Aug. 13, 2015. Retrieved at https://clinicaltrials.gov/ct2/show/NCT02520791.
Van Berkel et al., "CD28 and ICOS: Similar or separate costimulators of T cells?" Immunology Letters 105: 115-122 (2006).
Van Elsas et al., "Combination Immunotherapy of B16 Melanoma Using Anti-Cytotoxic T Lymphocyte-associated Antigen 4 (CTLA-4) and Granulocyte/Macrophage Colony-Stimulating Factor (GM-CSF)-producing Vaccines Induces Rejection of Subcutaneous and Metastatic Tumors Accompanied by Autoimmune Depigmentation," J Exp Med 190(3): 355-66 (1999).
Vazquez-Lombardi et al., "Potent antitumour activity of interleukin-2-Fc fusion proteins requires Fc-mediated depletion of regulatory T-cells," Nature Communications, vol. 8, May 12, 2017 (May 12, 2017), pp. 1-12.
Vetterman et al., "A signalling-enhanced chimeric receptor to activate the ICOS pathway in T cells," Journal of Immunological Methods 424: 14-19 (2015).
Vonderheide et al. 2010. "Tremelimumab in combination with exemestane in patients with advanced breast cancer and treatment-associated modulation of inducible costimulator expression on patient T cells." Clin. Cancer Res. 16:3485-3494.
Wang et al. "Costimulation of T cells by B7-H2, a B7-like molecule that binds ICOS." Blood. Oct. 15, 2000;96(8):2808-13.
Wang et al., "In Vitro Characterization of the Anti-PD-1 Antibody Nivolumab, BMS-936558, And In Vivo Toxicology in Non-Human Primates", Cancer Immunology Research, vol. 2, No. 9, May 28, 2014 (May 28, 2014), pp. 846-856.
Ward et al., "Targeting Costimulatory Pathways for Tumor Immunotherapy," International Reviews of Immunology, 26:161-196 (2007).
West et al., "PD-L 1 blockade synergizes with IL-2 therapy in reinvigorating exhausted T cells", J Clin Invest, 123(6):2604-15 (2013).
Wozniak-Knopp et al., "Introducing antigen-binding sites in structural loops of immunoglobulin constant domains : Fc fragments with engineered HER2/neu-binding sites and antibody properties," Protein Engineering, Design & Selection, 23(4); 289-297 (2010).
Yang et al., "Programmed cell death-ligand 1 expression in surgically resected stage I pulmonary adenocarcinoma and its correlation with driver mutations and clinical outcomes", Eur J Cancer, 50(7):1361-9 (2014).
Yap et al., "ICONIC : Biologic and clinical activity of first in class ICOS against antibody JTX-2011 +/- nivolumab (nivo) in patients with advanced cancers," Presented at 2018 ASCO Annual Meeting (18 pages).
Yusa K, et al. "A hyperactive piggyBac transposase for mammalian applications," Proc Natl Acad Sci U S A. Jan. 25, 2011.
Zang et al., "The B7 family and cancer therapy: costimulation and coinhibition," Clinical Cancer Research, 13(18): 5271-5279 (2007).
Baruch, et al., Aging-Induced type I Interferon Response at the Choroid Plexus Negatively Affects Brain Function, Science 346(6205): 89-93 (2014).
Baruch, et al., Breaking Immune Tolerance by Targeting Foxp3(+) Regulatory T Cells Mitigates Alzheimer's Disease Pathology, Nat Commun. 6: 7967-7978 (2015).
Baruch, et al., Cerebral Nitric Oxide Represses Choroid Plexus NFκB-Dependent Gateway Activity for Leukocyte Trafficking, EMBO J. 34(13): 1816-1828 (2015).
Baruch, et al., CNS-Specific Immunity at the Choroid Plexus Shifts Toward Destructive Th2 Inflammation in Brain Aging, Proc. Natl. Acad. Sci. U. S. A. 110 (6): 2264-2269 (2013).
Baruch and Schwartz, CNS-specific T Cells Shape Brain Function via the Choroid Plexus, Brain Behav. Immun. 34: 11-16 (2013).
Cauvin et al. (2015) Advantages and Limitations of Commonly Used Nonhuman Primate Species in Research and Development of Biopharmaceuticals in The Nonhuman Primate in Nonclinical Drug Development and Safety Assessment (Academic Press), 379-395.
Kunis, et al., IFN-γ-Dependent Activation of the Brain's Choroid Plexus forCNS Immune Surveillance and Repair, Brain 136: 3427-3440 (2013).
Kunis, et al., Immunization with a Myelin-Derived Antigen Activates the Brain's Choroid Plexus for Recruitment of Immunoregulatory Cells to the CNS and Attenuates Disease Progression in a Mouse Model of ALS, J. Neurosci. 35(16): 6381-6393 (2015).
Rosenzweig, et al., PD-1/PD-L1 Checkpoint Blockade Harnesses Monocyte-Derived Macrophages to Combat Cognitive Impairment in a Tauopathy Mouse Model, Nat Commun. 10(1): 465-479 (2019).
Schwartz and Baruch, The Resolution of Neuroinflammation in Neurodegeneration: Leukocyte Recruitment via the Choroid Plexus, EMBO J. 33(1): 7-20 (2014).
U.S. Appl. No. 15/211,504 U.S. Pat. No. 9,567,399, filed Jul. 15, 2016 Feb. 14, 2017, Jamie Campbell, Antibodies And Immunocytokines.
U.S. Appl. No. 15/354,971 U.S. Pat. No. 9,617,338, filed Nov. 17, 2017 Apr. 11, 2017, Jamie Campbell, Antibodies And Immunocytokines.
U.S. Appl. No. 15/480,525 2017/0362321 U.S. Pat. No. 10,604,576, filed Apr. 6, 2017 Dec. 21, 2017 Mar. 31, 2020, Jamie Campbell, Antibodies And Immunocytokines.
U.S. Appl. No. 16/311,440 2019/0330351, filed Jun. 20, 2017 Oct. 31, 2019, Jamie Campbell, Anti-PD-L1 Antibodies.
U.S. Appl. No. 17/243,372 2021/0380699, filed Apr. 28, 2021 Dec. 9, 2021, Jamie Campbell, Anit-PD-L1 Antibodies.
U.S. Appl. No. 16/323,980 2019/0330345, filed Feb. 7, 2019 Oct. 31, 2019, Richard Charles Alfred Sainson, Anti-ICOS Antibodies.
U.S. Appl. No. 17/727,288, filed Apr. 22, 2022, Richard Charles Alfred Sainson, Anti-ICOS Antibodies.
U.S. Appl. No. 17/727,309, filed Apr. 22, 2022, Richard Charles Alfred Sainson, Anti-ICOS Antibodies.
U.S. Appl. No. 16/955,197 2020/0317786, filed Jun. 18, 2020 Oct. 8, 2020, Aksana Labokha, Anti-ICOS Antibodies.
U.S. Appl. No. 16/311,421 2019/0202917, filed Dec. 19, 2018 Jul. 4, 2019, Jamie Campbell, Antibodies To ICOS.
U.S. Appl. No. 17/901,800, filed Sep. 1, 2022, Jamie Campbell, Multispecific Antibodies For Immuno-Oncology.
U.S. Appl. No. 16/955,219 2020/0407446, filed Jun. 18, 2020 Dec. 31, 2020, Matthew John McCourt, Multispecific-Antibodies For Immuno-Oncology.
U.S. Appl. No. 16/741,161 2020/0190191, filed Jun. 19, 2019 Jun. 18, 2020, Jamie Iain Campbell, Bispecific Antibody For ICOS And PD-L1.
U.S. Appl. No. 17/747,886, filed May 18, 2022, Richard Charles Alfred Sainson, Multispecific Antibody with Combination Therapy for Immuno-Oncology.
U.S. Appl. No. 17/921,822, filed May 13, 2021, Richard Charles Alfred Sainson, Uses Of Anti-ICOS Antibodies.
Almagro et al., Humanization of antibodies, Frontiers in Bioscience, 13: 1619-1633 (2008).
Brinkmann et al., The making of bispecific antibodies, MABS 9(2): 182-212 (2017).

(56) References Cited

OTHER PUBLICATIONS

Chemical Society of Japan Lecture Proceedings, 2014, 94(3): 974 (Japanese language only).
Chen et al., Human monoclonal antibodies targeting the haemagglutinin glycoprotein can neutralize H7N9 influenza virus. Nat Commun. Mar. 30, 2015;6:6714.
Enzyme Engineering News, Jun. 2014, 75: 11-14 (Japanese language only).
Eun et al., Prolonged Survival in Rat Composite Tissue Allografts Treated with Combined Administration of ICOS-lg and CTLA4-lg, The Journal of Japanese Society for Surgery of the Hand, 2005, 22(1): S86 (1-Pb-7).
General Presentation Poster, The Japanese Journal of Nephrology, 2004, 46(3): 249 (P-113), obtained from https://www.jstage.jst.go.jP/article/jpnjnephrol1959/46/3/46_3_231/_pdf/-char/en.
Gul et al., Antibody-Dependent Phagocytosis of Tumor Cells by Macrophages: A Potent Effector Mechanism of Monoclonal Antibody Therapy of Cancer, Cancer Res., 75(23), Dec. 1, 2015.
International Search Report and Written Opinion for PCT International Patent Application No. PCT/EP2022/050110, dated Mar. 29, 2022.
International Search Report and Written Opinion for PCT International Patent Application No. PCT/EP2022/063450, dated Sep. 12, 2022.
Jachimowicz et al., Multi-specific antibodies for cancer immunotherapy. BioDrugs. 2014, 28(4): 331-343.
Kubo et al., Dendritic Cell and Cancer Immune Checkpoint, The Japanese Journal of Clinical Immunology, 2016, 39(5): 468-472.
Pan et al., Further Study of Anti-ICOS Immunotherapy for Rat Cardiac Allograft Rejection, Surgery Today, 2008, 38(9): 815-825.
Seshasayee et al., In vivo blockade of OX40 ligand inhibits thymic stromal lymphopoietin driven atopic inflammation, J Clin Invest, 117(12): 3868-3878 (2007).
Sharma et al., The future of immune checkpoint therapy, Science, 348(6230): 56-61 (2015).
Sim et al., IL-2 variant circumvents ICOS+ regulatory T cell expansion and promotes NK cell activation, Cancer Immunol Res, Nov. 2016, 4(11): 983-994.
Strohl, Fusion Proteins for Half-Life Extension of Biologies as a Strategy to Make Biobetters. BioDrugs (2015) 29: 215-239.
Taylor et al., The classification of amino acid conservation, J. Theor. Biol., 1986, 119:205-218.
Taylor, AstraZeneca tremelimumab fails another phase 3 cancer trial, Published online Dec. 7, 2018 at https://fiercebiotech.com/biotech/astrazeneca-s-tremelimumab-fails-another-phase-3-cancer-trial (4 pages).
West et al., PD-L 1 blockade synergizes with IL-2 therapy in reinvigorating exhausted T cells, J Clin Invest, 123(6): 2604-2615 (2013).
Winkler et al., Changing the antigen binding specificity by single point mutations of an anti-p24 (HIV-1) antibody, Journal of Immunology, Oct. 15, 2000, 165(8): 4505-4514.
Yap et al., ICONIC : Biologic and clinical activity of first in class ICOS against antibody JTX-2011 +/−nivolumab (nivo) in patients with advanced cancers, Presented at 2018 ASCO Annual Meeting.

\* cited by examiner

Constant Region.

```
WT_CH1    --ASTKGPSVFPLAPSSKSTS-----GGTAALGCLVKDYFP--EPVTVSWNSGALTS-----GVHTFPAVLQS
FCAB_CH1  --ASTKGPSVFPLAPSSKSTS-----GGTAALGCLVKDYFP--EPVTVSWNSGALTS-----GVHTFPAVLQS
WT_CH2    APELLGGPSVFLFPPKPKDTLMI-SRTPEVTCVVVDVSHEDPEVKFNWYVDGVEVH----NAKTKPREEQY
FCAB_CH2  APELLGGPSVFLFPPKPKDTLMI-SRTPEVTCVVVDVSHEDPEVKFNWYVDGVEVH----NAKTKPREEQY
WT_CH3    --GQPREPQVYTLPPSRDELT----KNQVSLTCLVKGFYP--SDIAVEWESNGQPEN---NYKTTPPVLDS
FCAB_CH3  --GQPREPQVYTLPPSRDE--S---GYWVSLTCLVKGFYP--SDIAVEWESNGEPQY---WAKTTPPVLDS
                                A Strand    AB Turn  B Strand      BC Loop        C Strand      CD Strand    D Strand DE Turn WT_CH1    S------GLYSLSSVVTVPSSSL----GTQTYICNVNHKP--SNTKVDKKV------
FCAB_CH1  S------GLYSLSSVVTVPSSSL----GTQTYICNVNHKP--SNTKVDKKV------
WT_CH2    N------STYRVVSVLTVLHQDW--LNGKEYKCKVSNKA--LPAPIEKTISKAK----
FCAB_CH2  N------STYRVVSVLTVLHQDW--LNGKEYKCKVSNKA--LPAPIEKTISKAK----
WT_CH3    D------GSFFLYSKLTVDKSRW--QQGNVFSCSVMHEA--LHNHYTQKSLSLSP---GK
FCAB_CH3  D------GSFFLYSKLTVSWWRW--QLDD-FSCSVMHEA--LHNHYTQKSLSLSP---GK
              DE Turn    E Strand   EF Turn F Strand        FG Loop            G Strand
```

Figure 2

A)
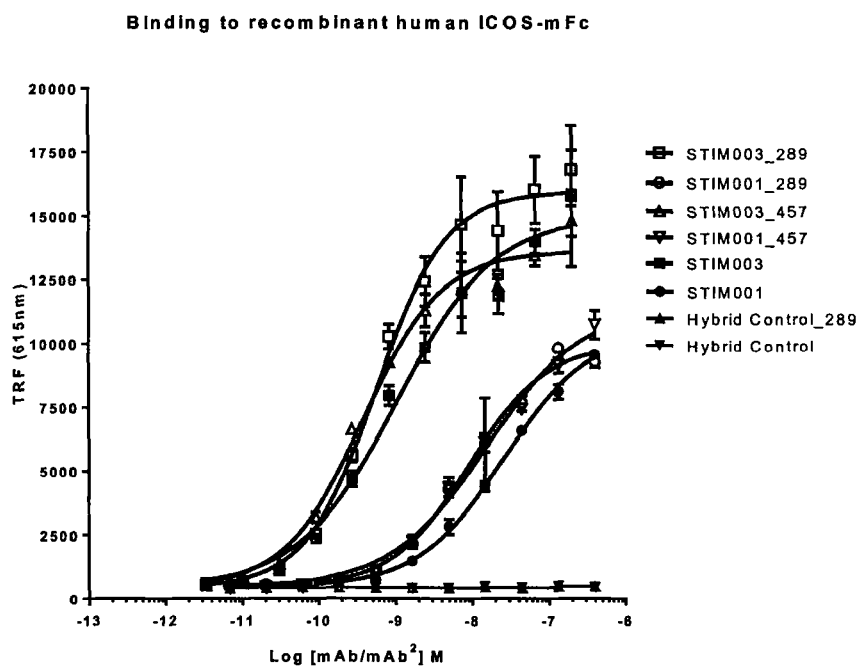
B)
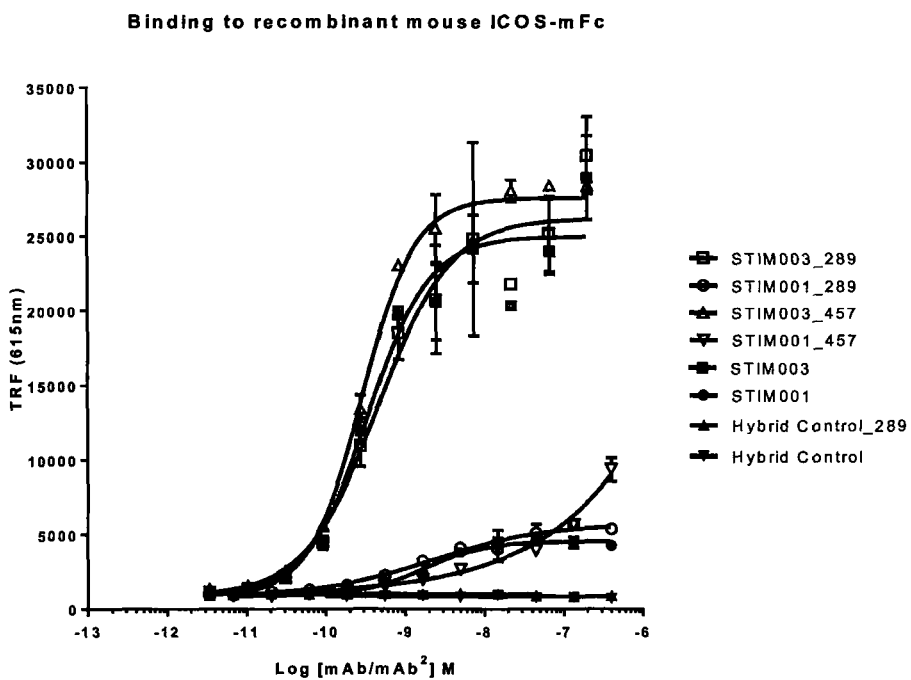
Figure 4 A and B

C)
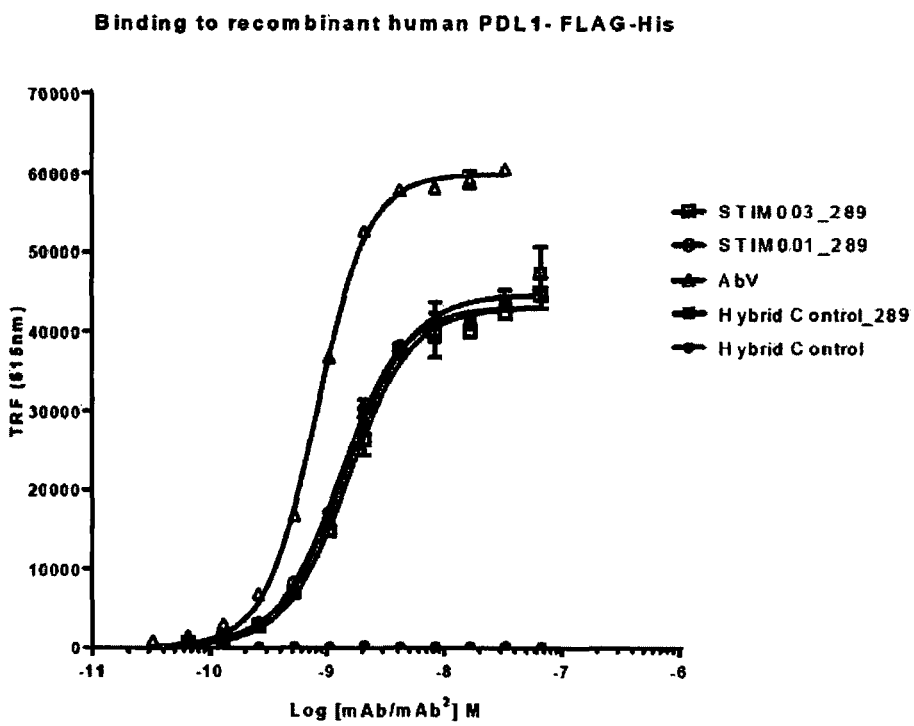
D)
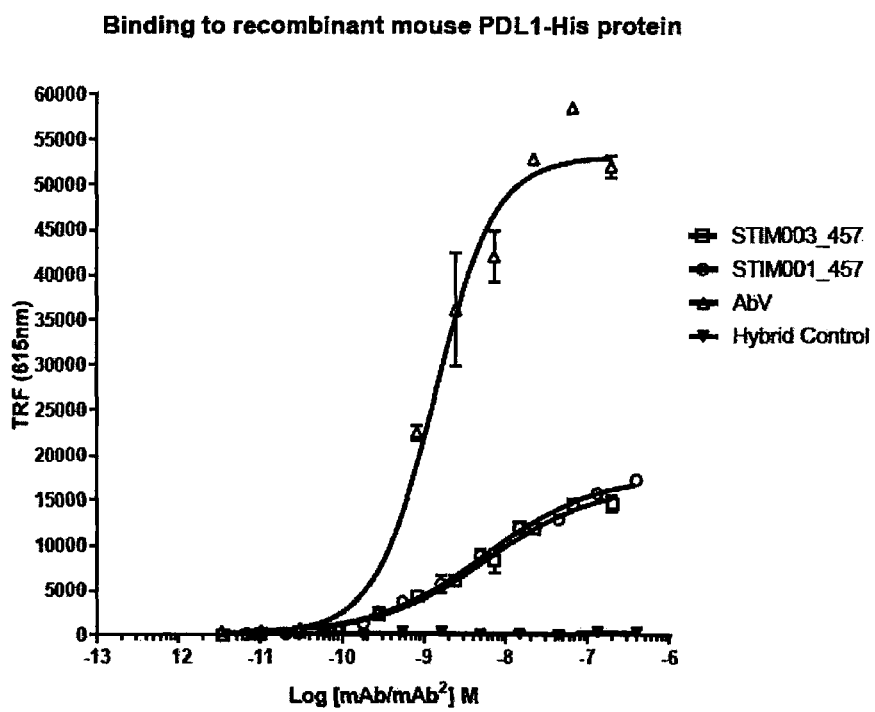
Figure 4 C and D (A)
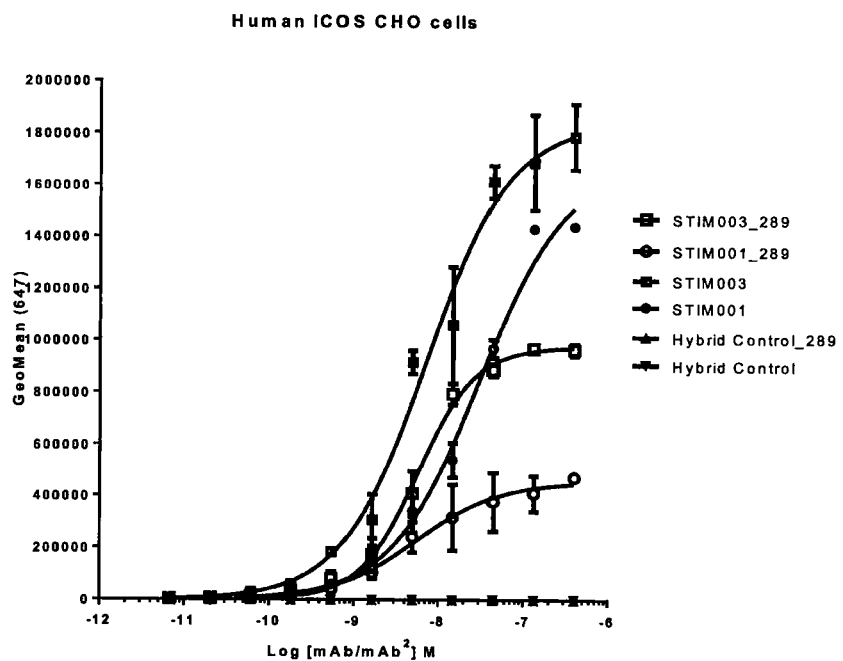
(B)
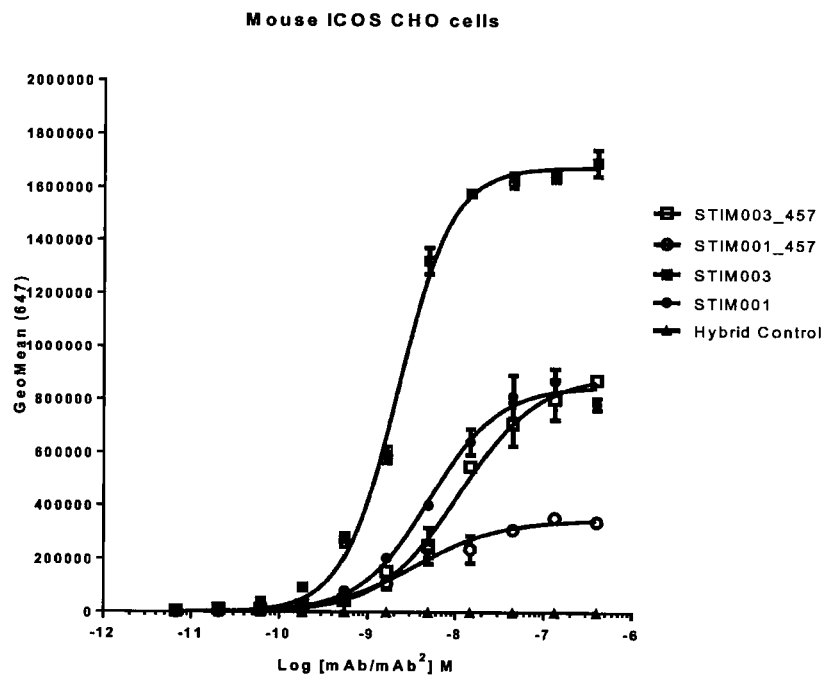
Figure 5

A
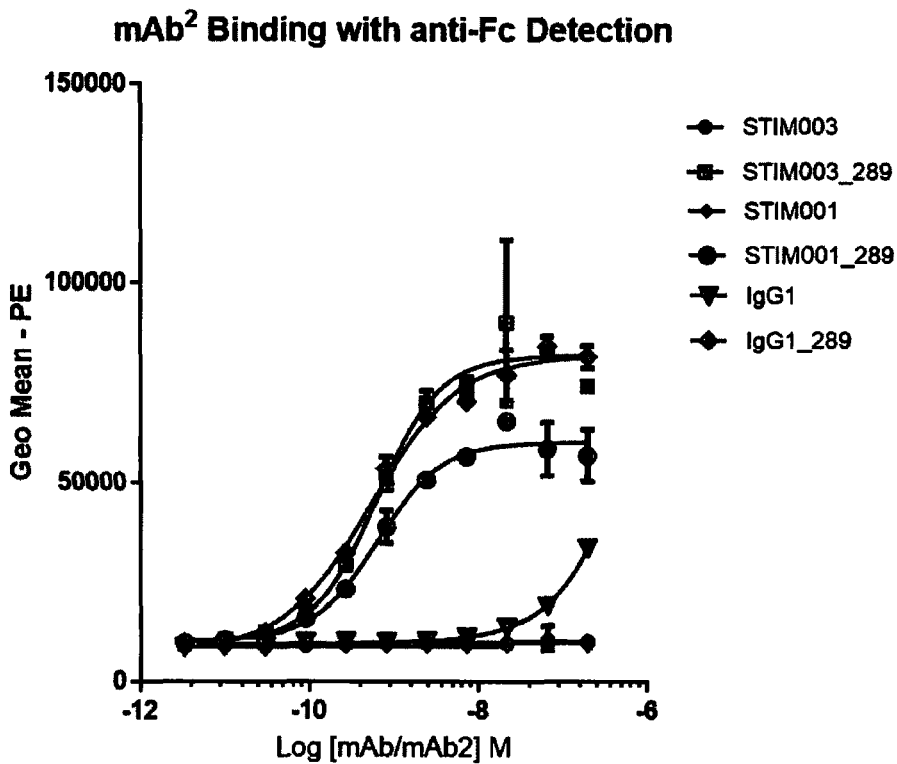
B
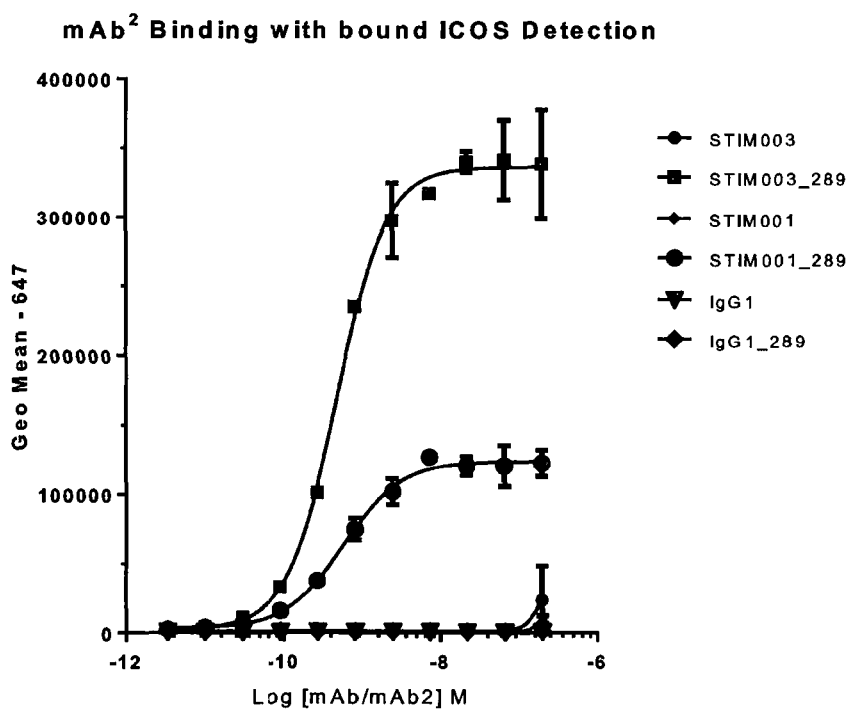
Figure 6

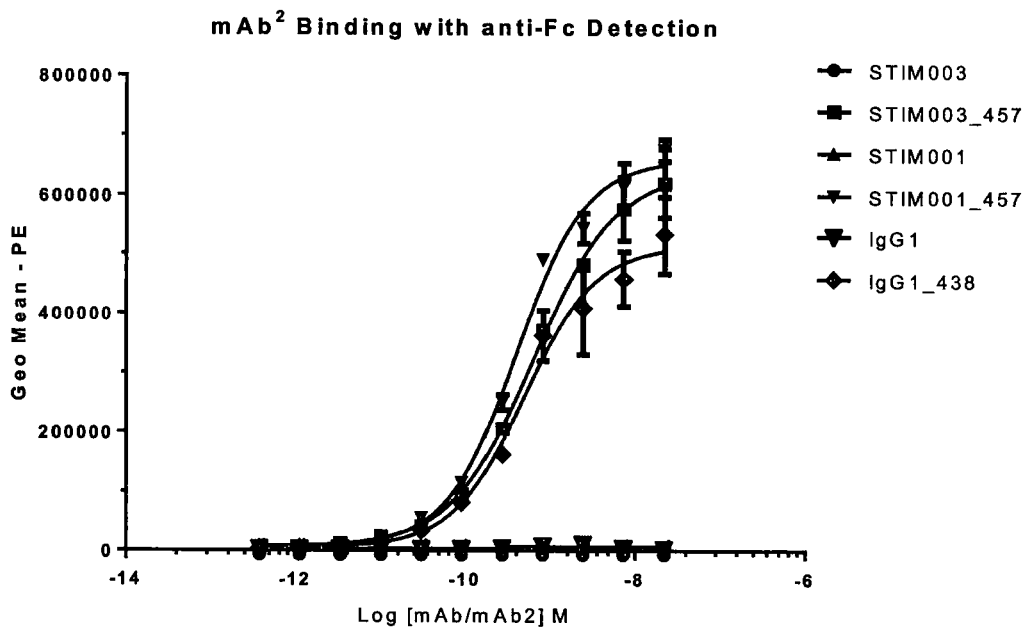
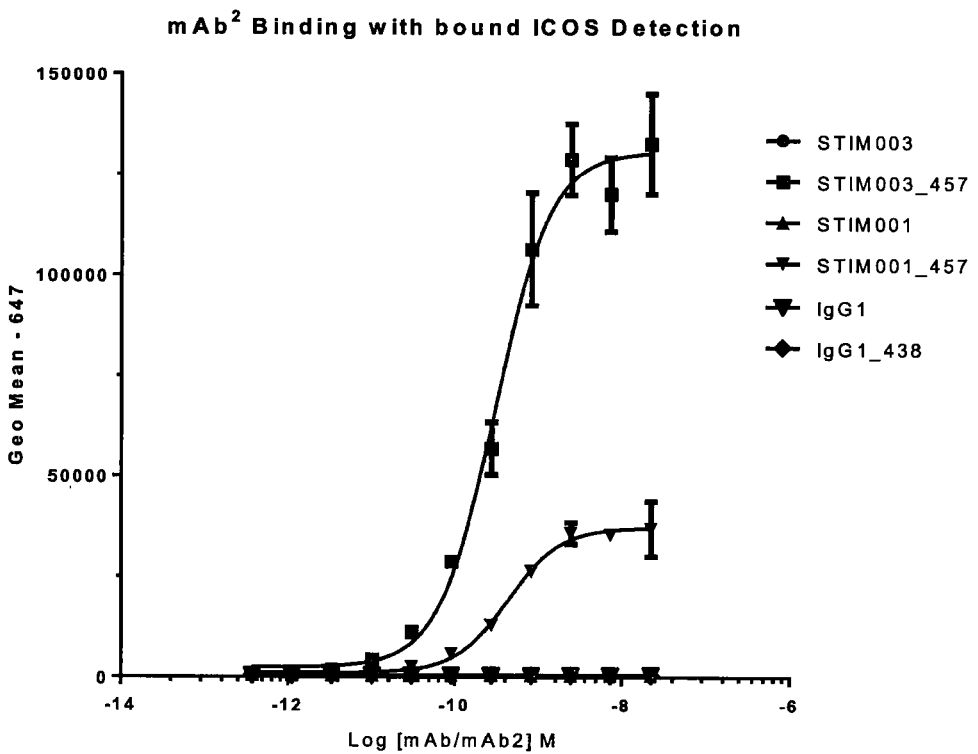
Figure 7

A)
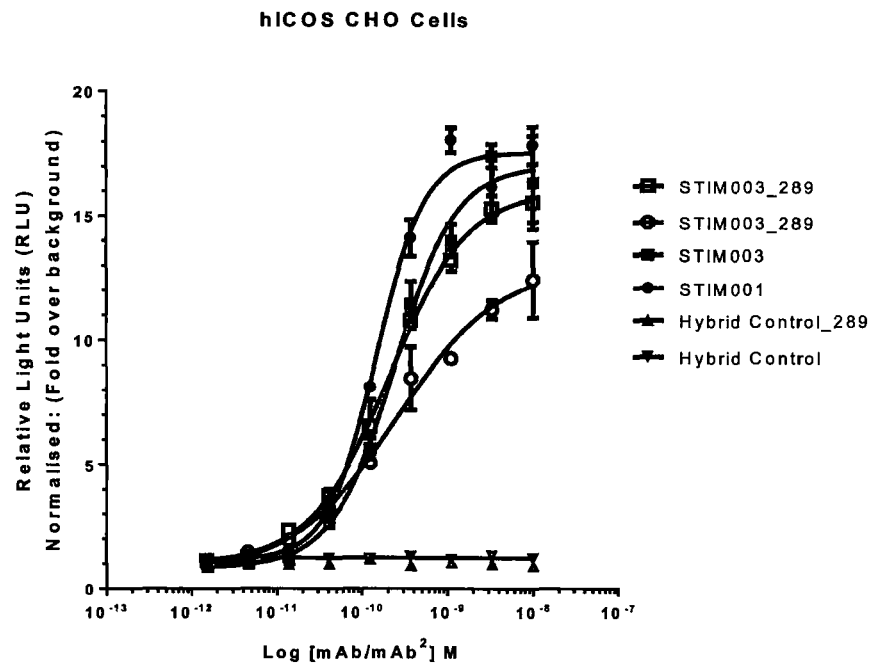
B)
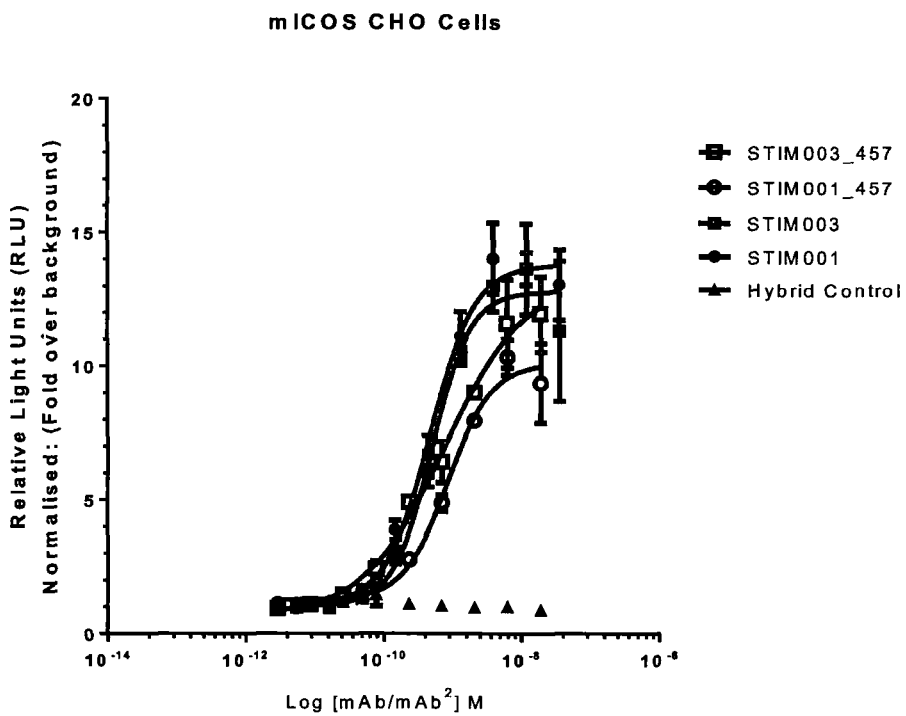
Figure 8

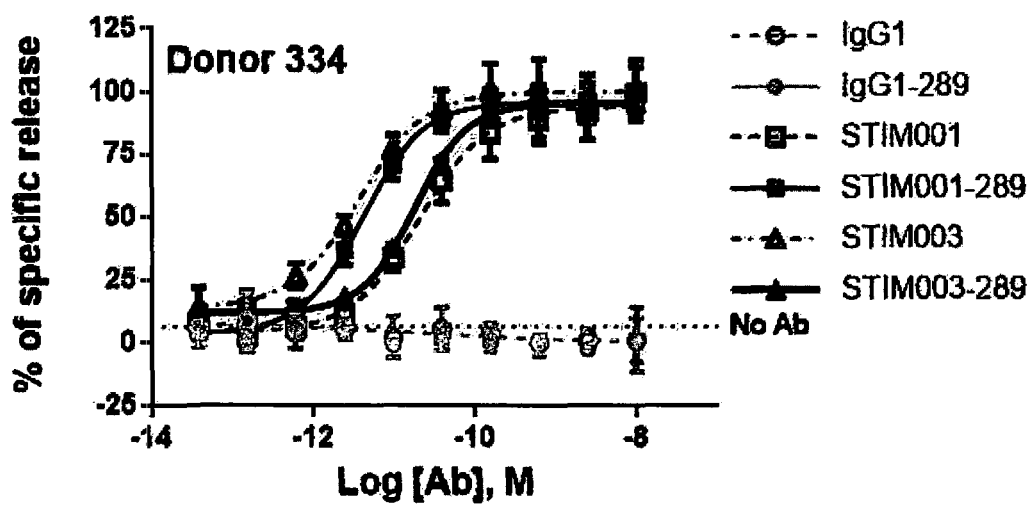
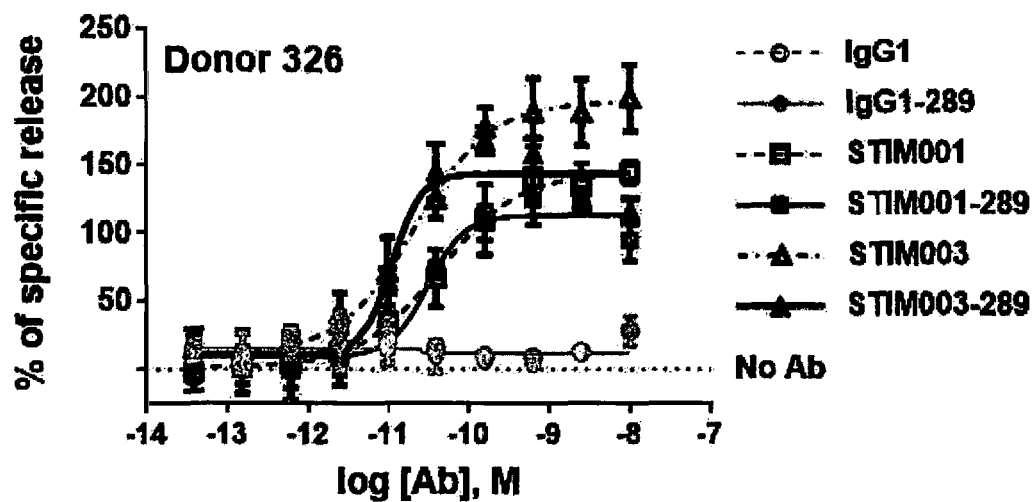
Figure 9 A and B

A)
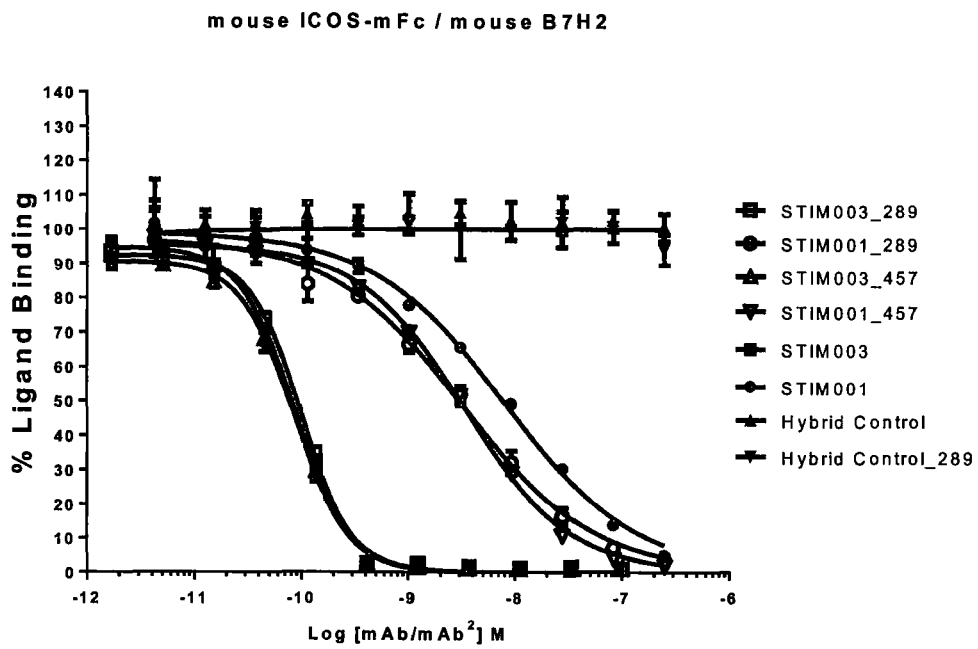
B)
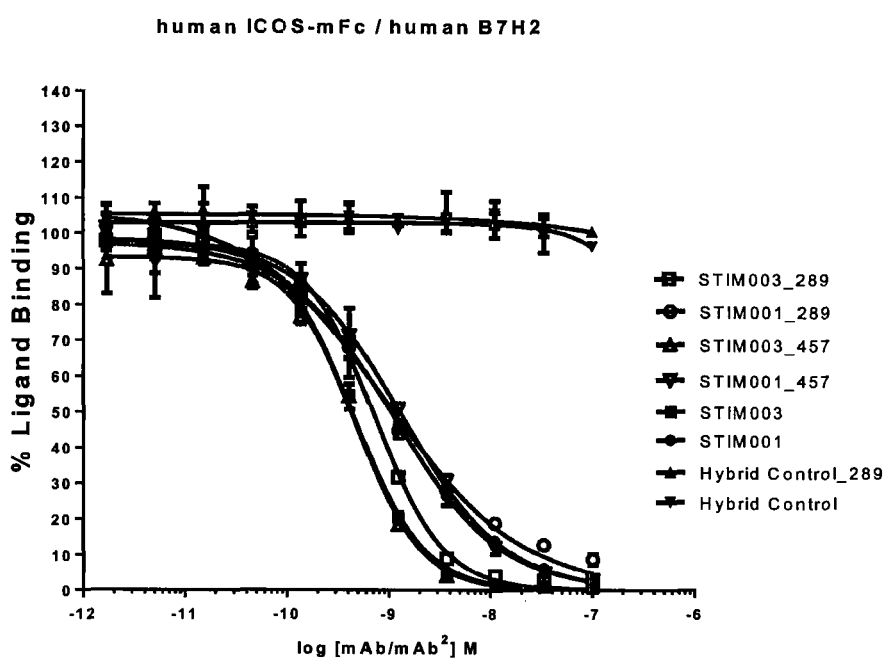
Figure 10

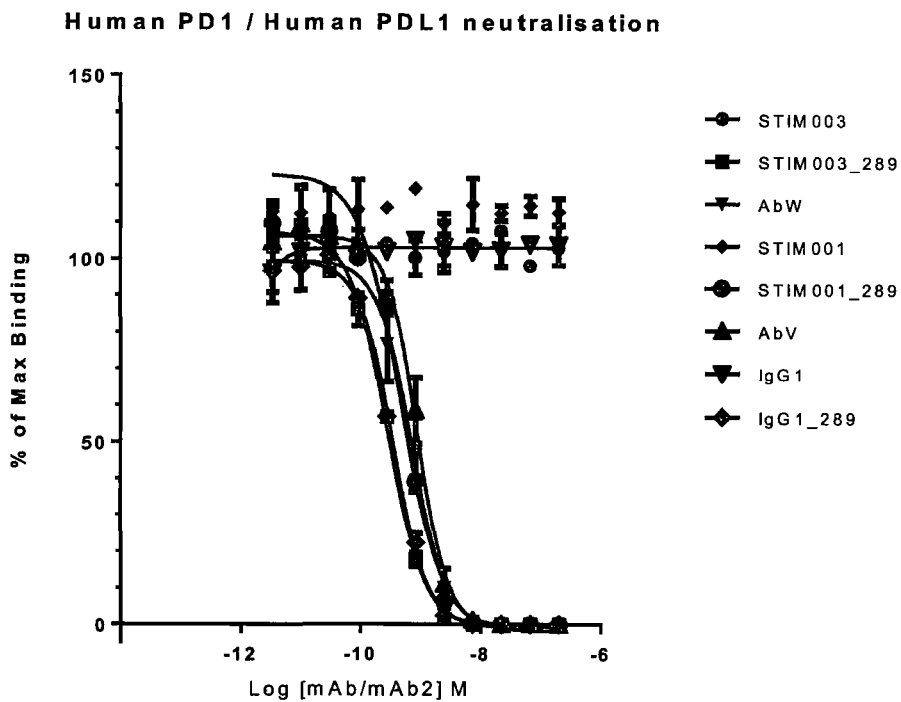
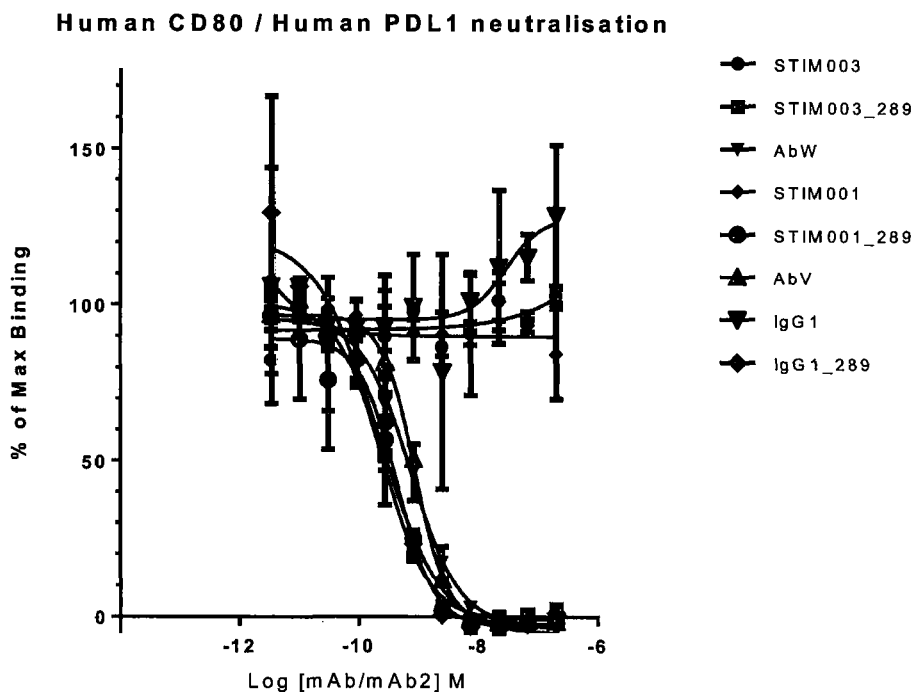
Figure 11

A)
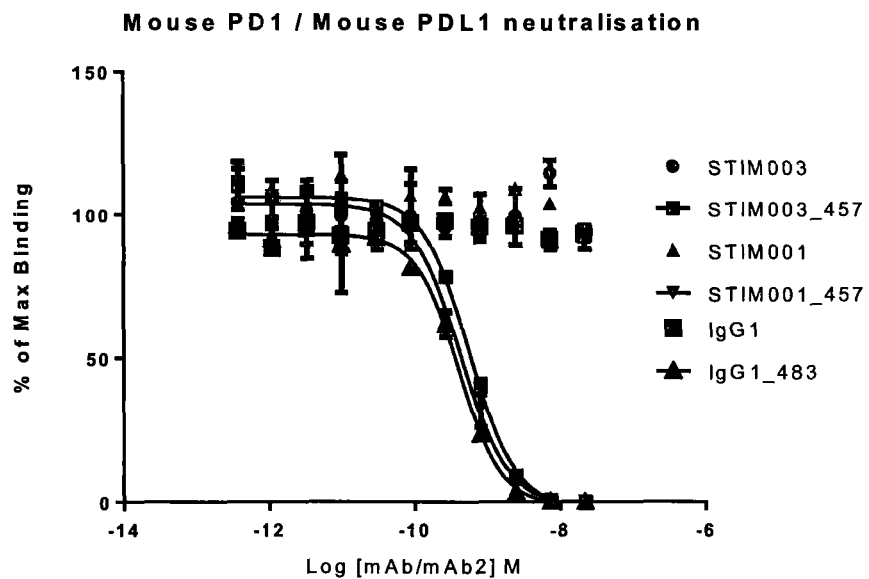
B)
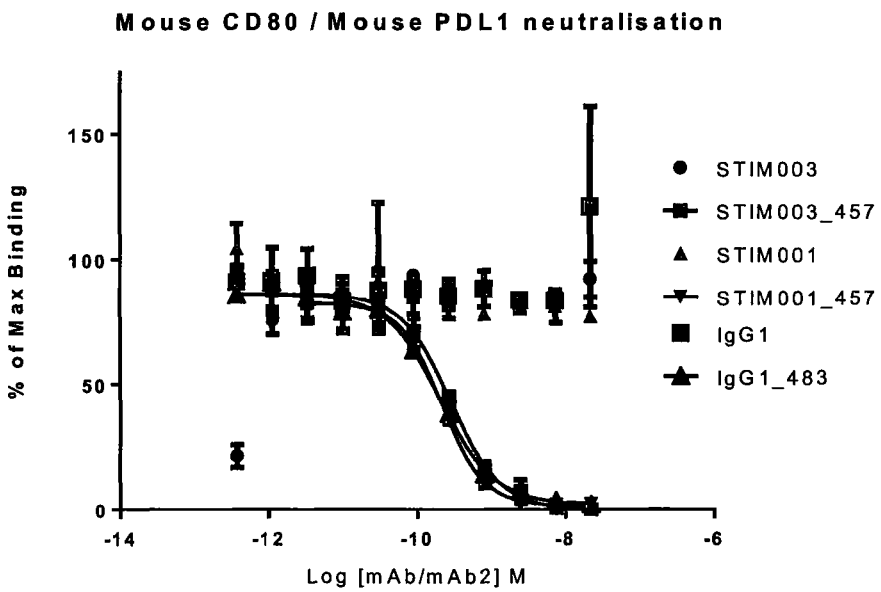
Figure 12

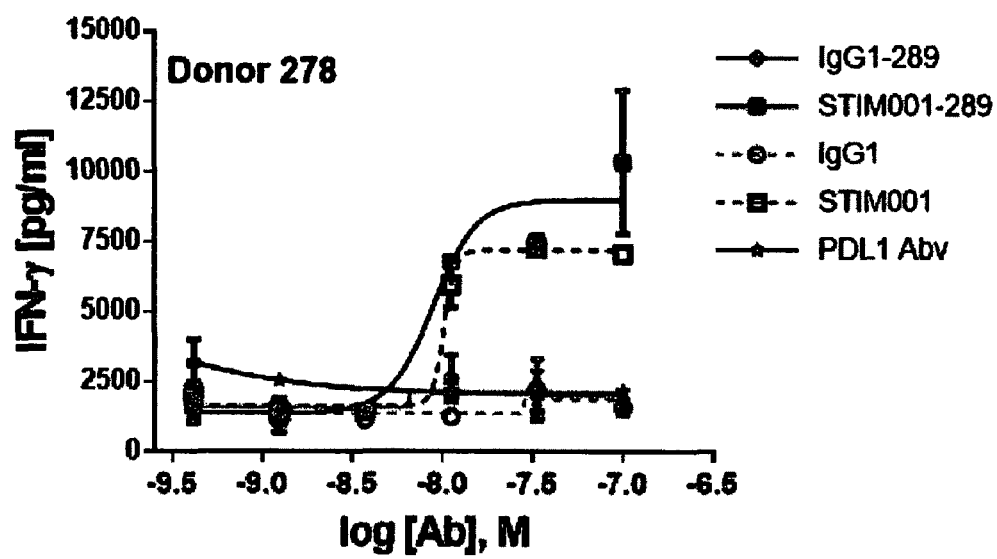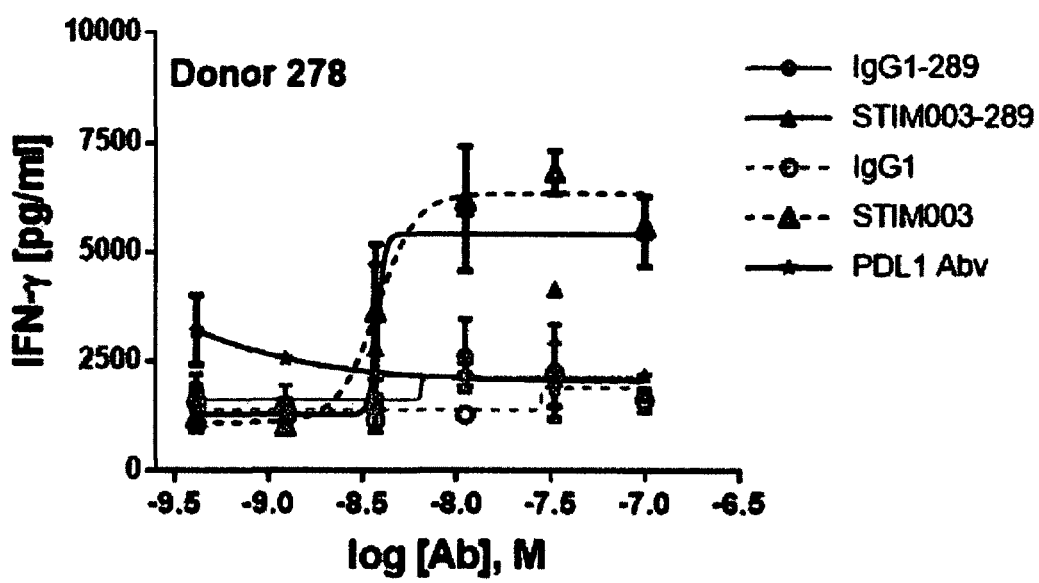
Figure 13 A and B

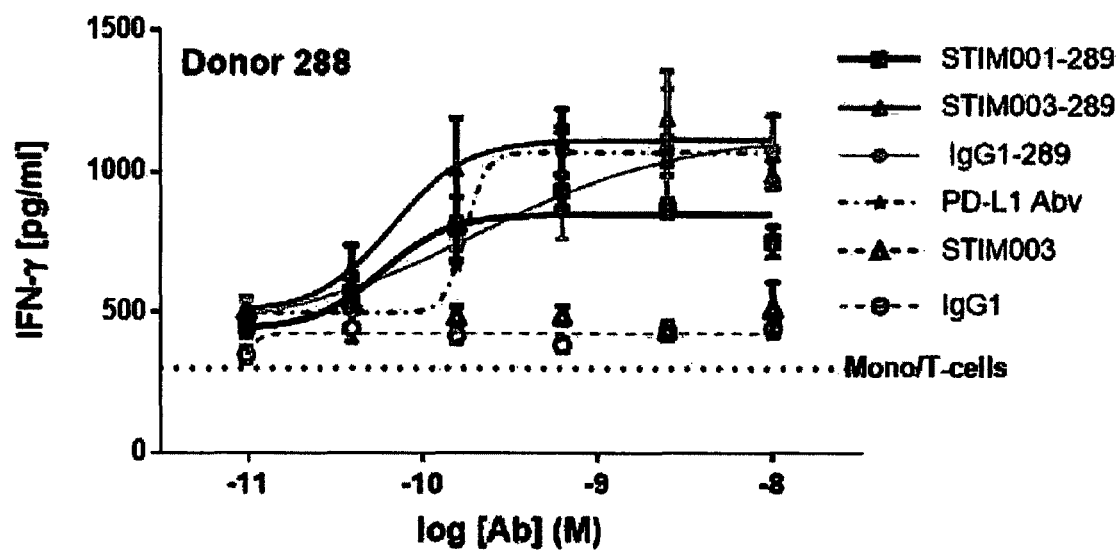
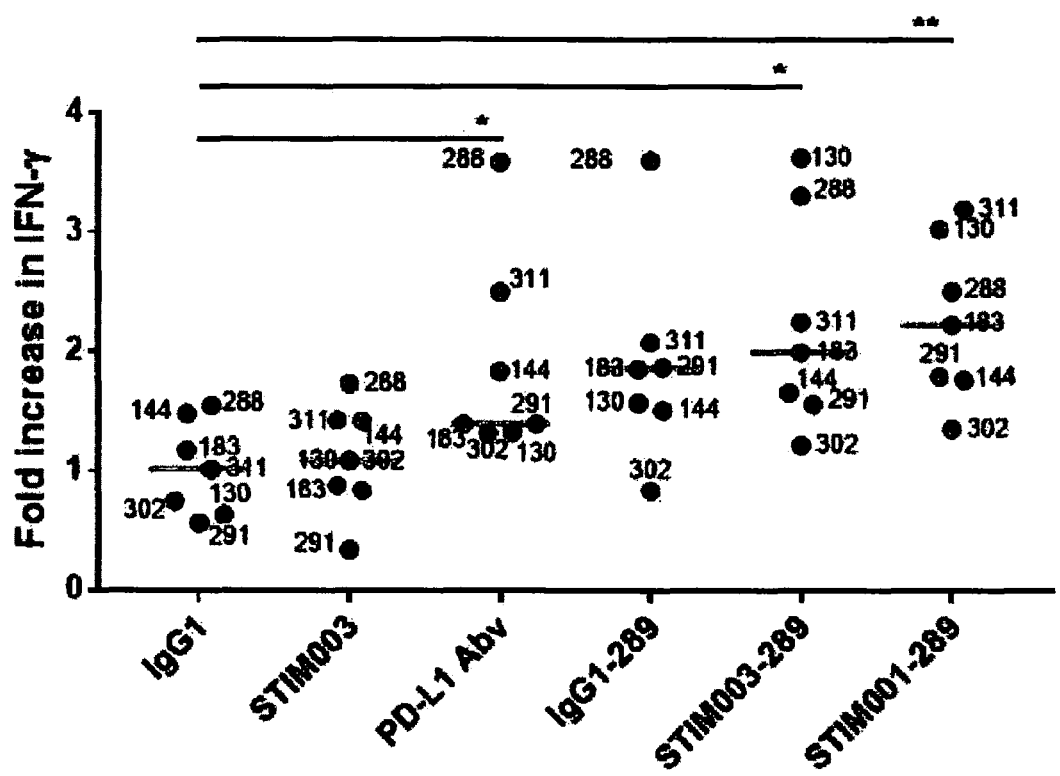
Figure 14

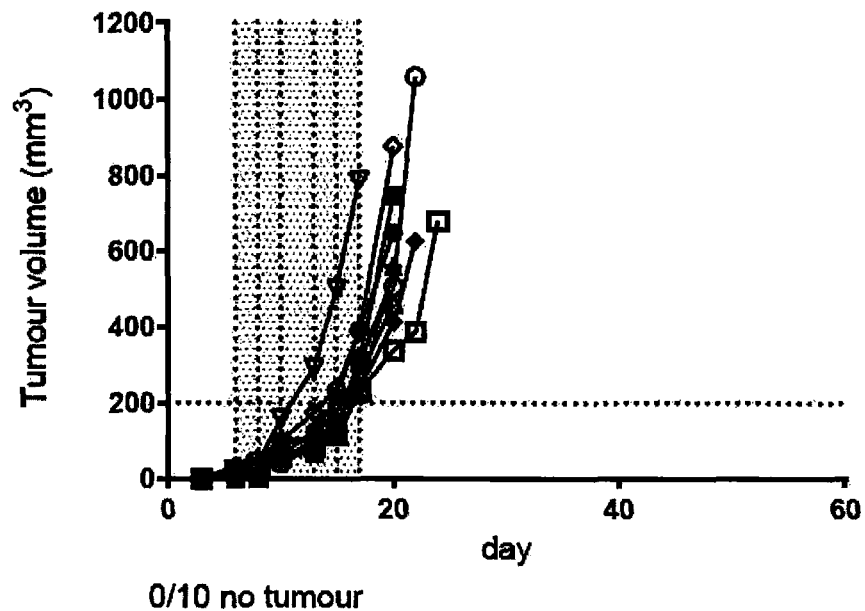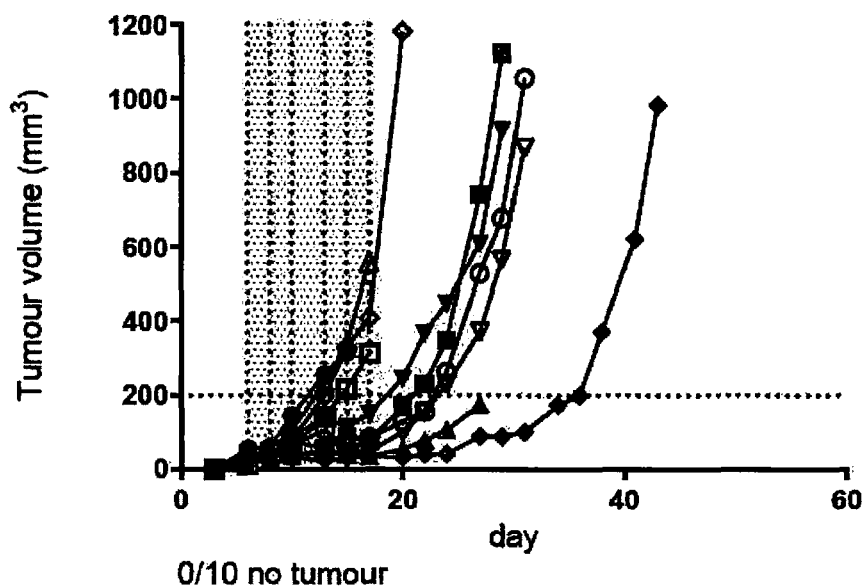
Figure 17 A and B

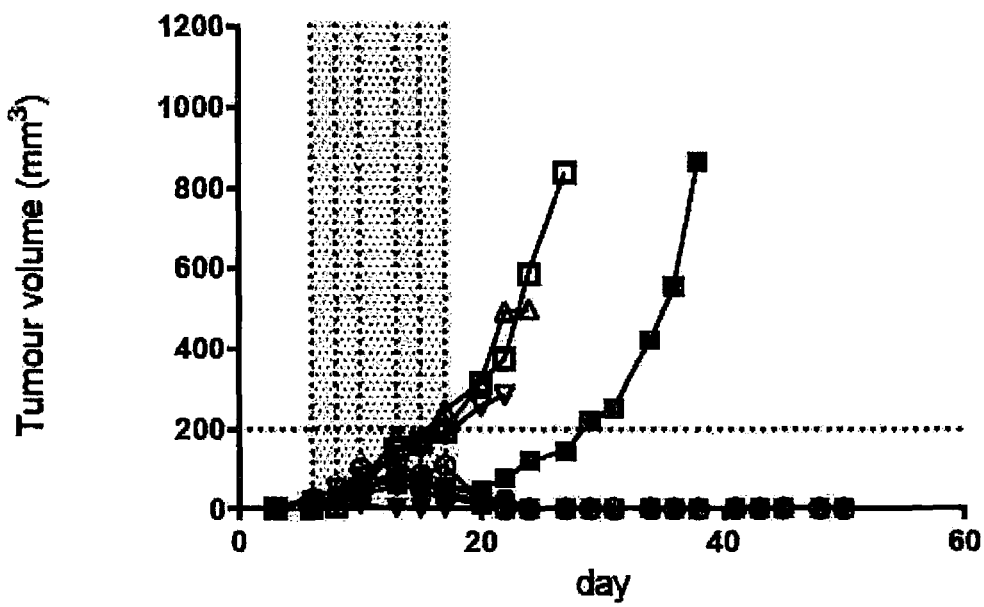
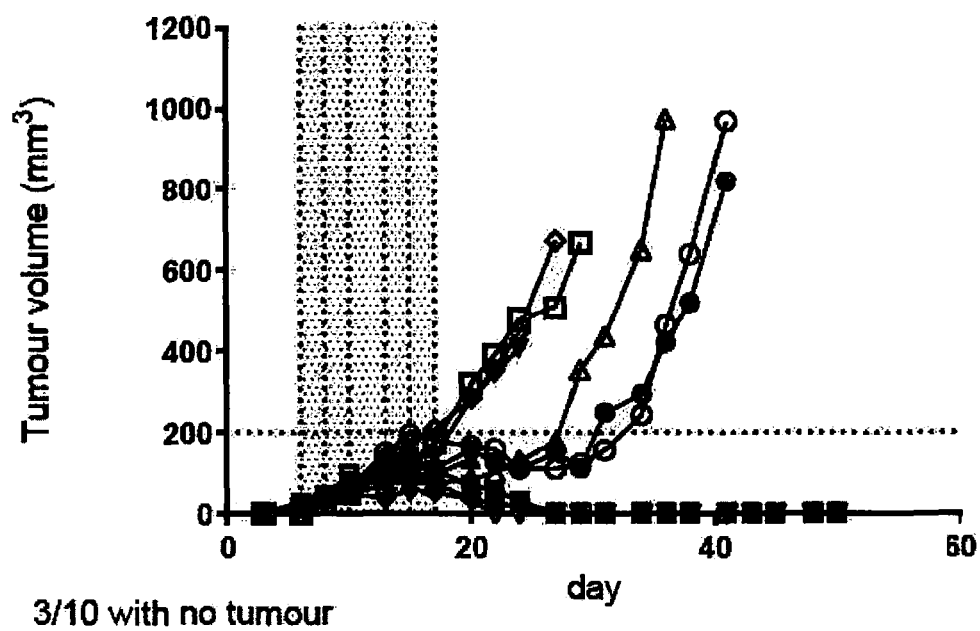
Figure 17 C and D

A)
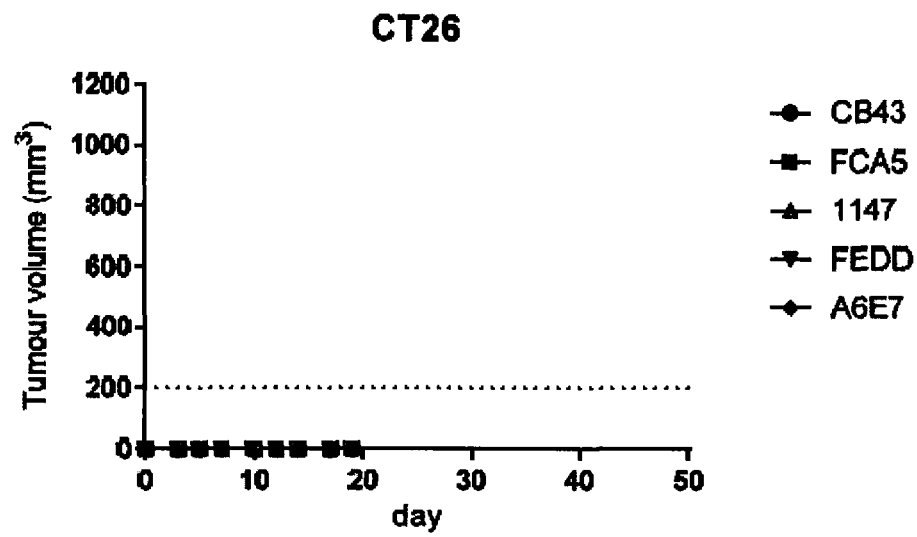
B)
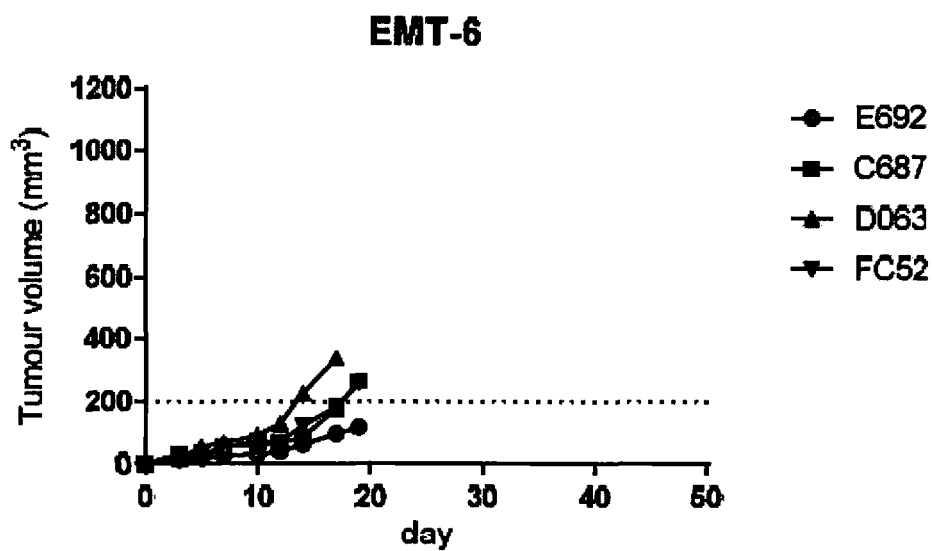
Figure 19

A) Saline
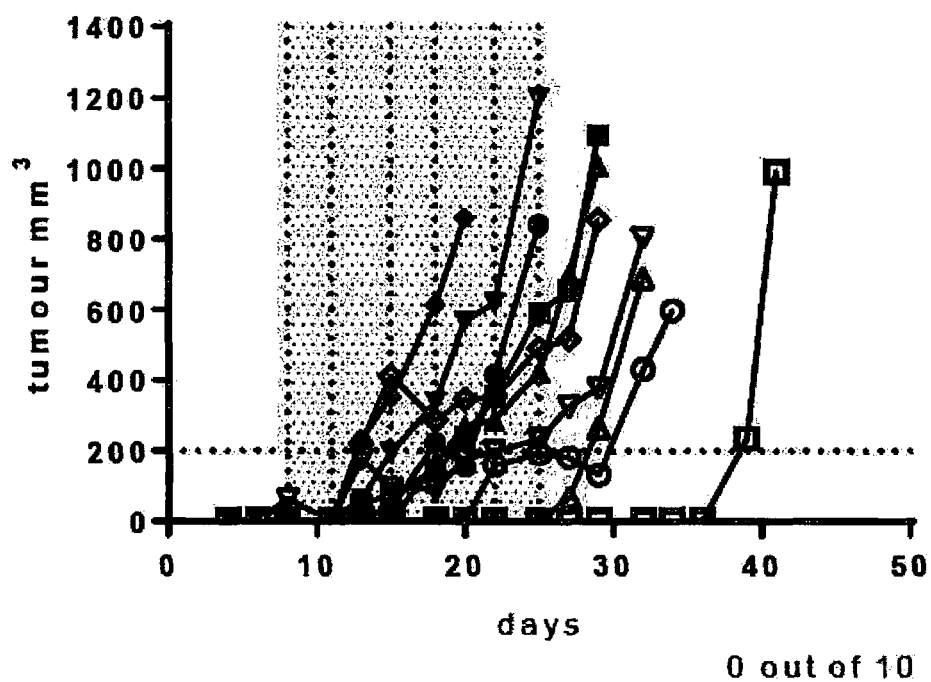
0 out of 10
B) IgG1_457
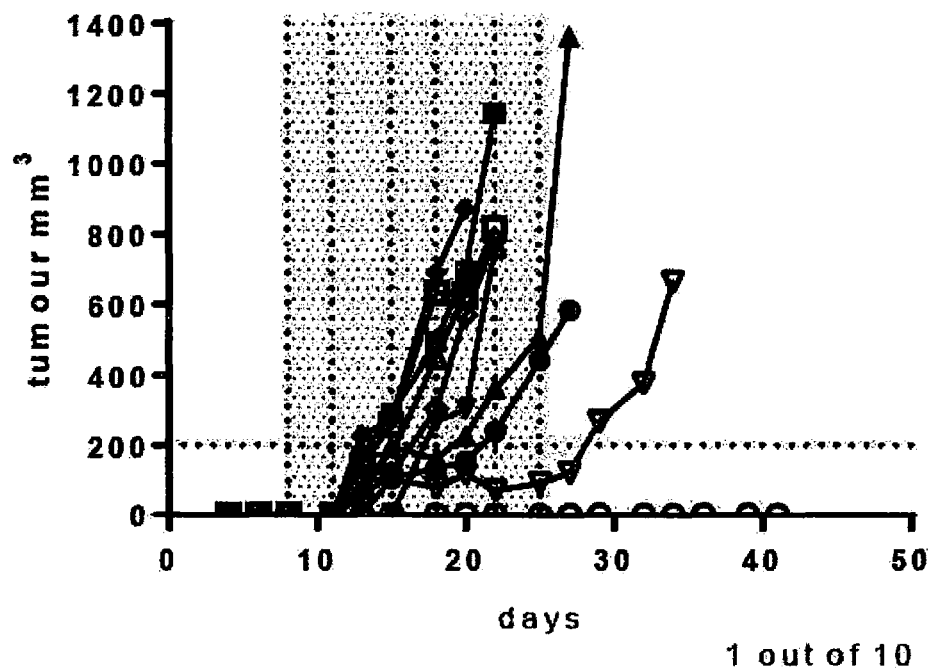
1 out of 10
Figure 20 A and B C) STIM003_457
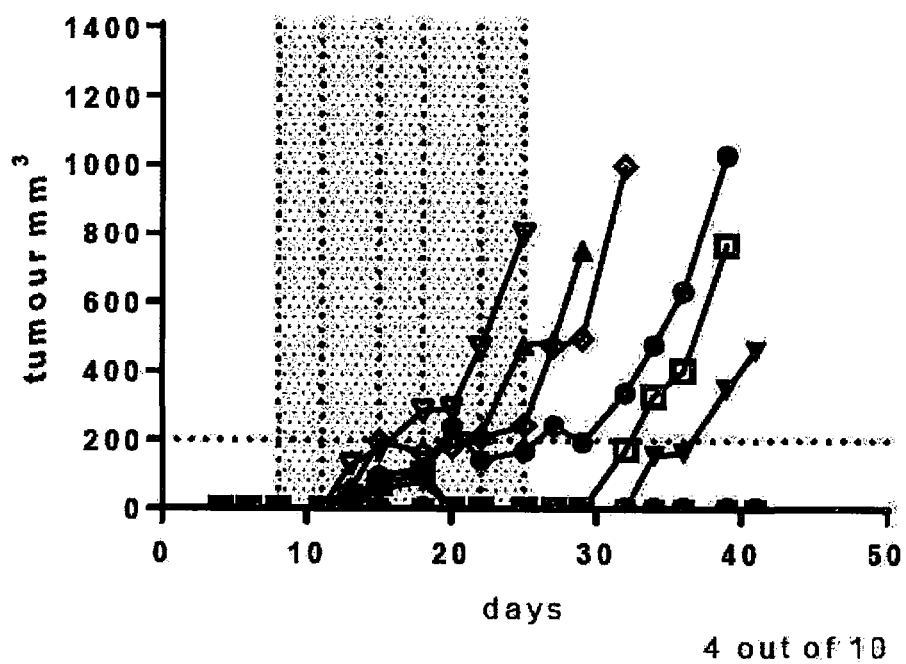
4 out of 10
D) STIM001_457
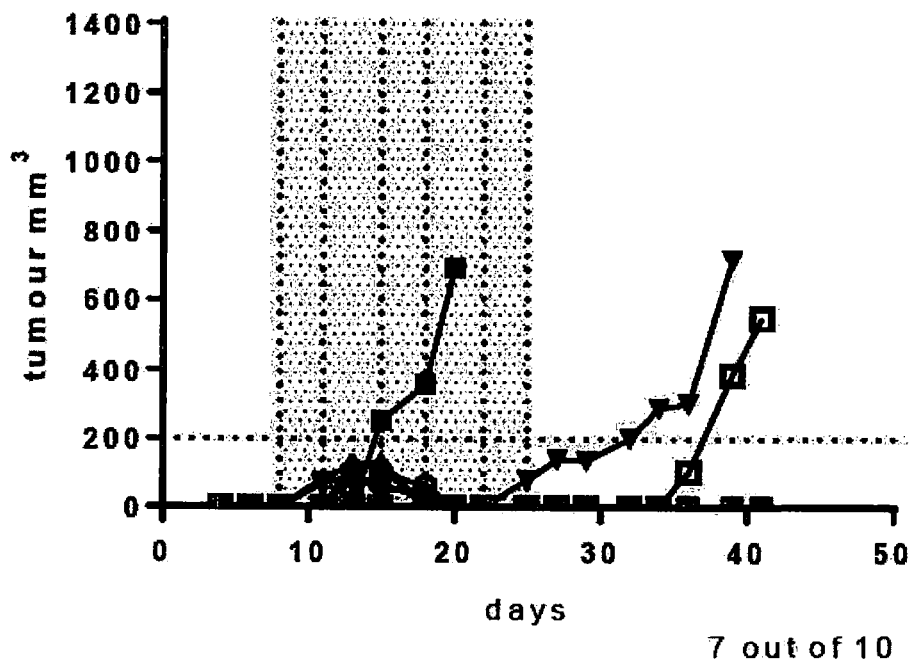
7 out of 10
Figure 20 C and D A)
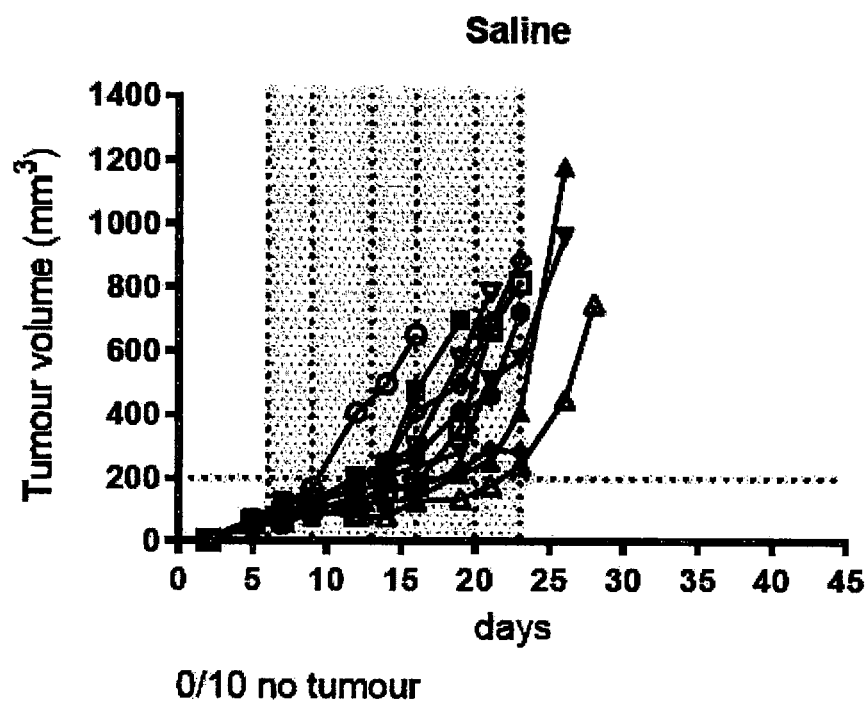
0/10 no tumour
B)
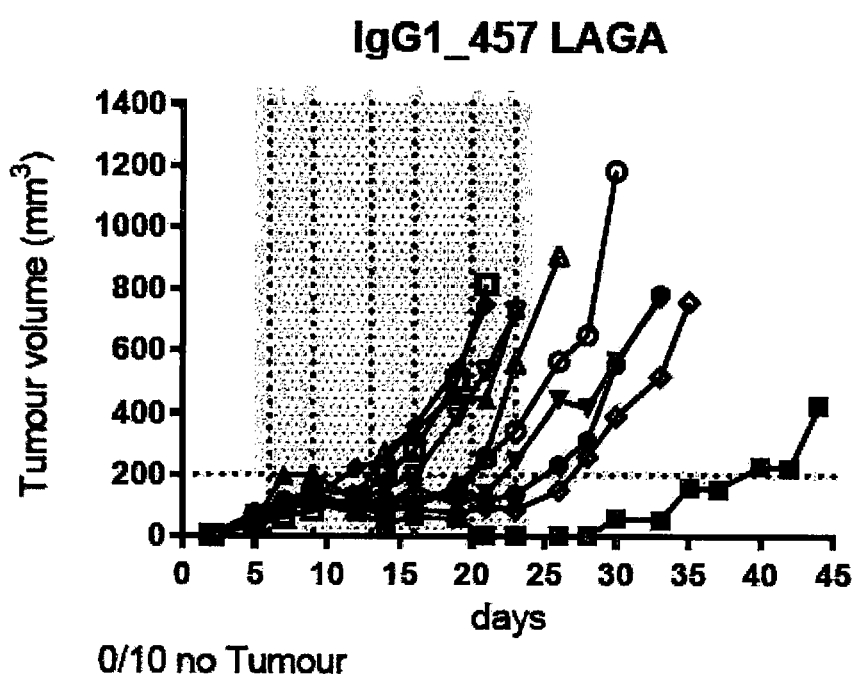
0/10 no Tumour
Figure 22 A and B

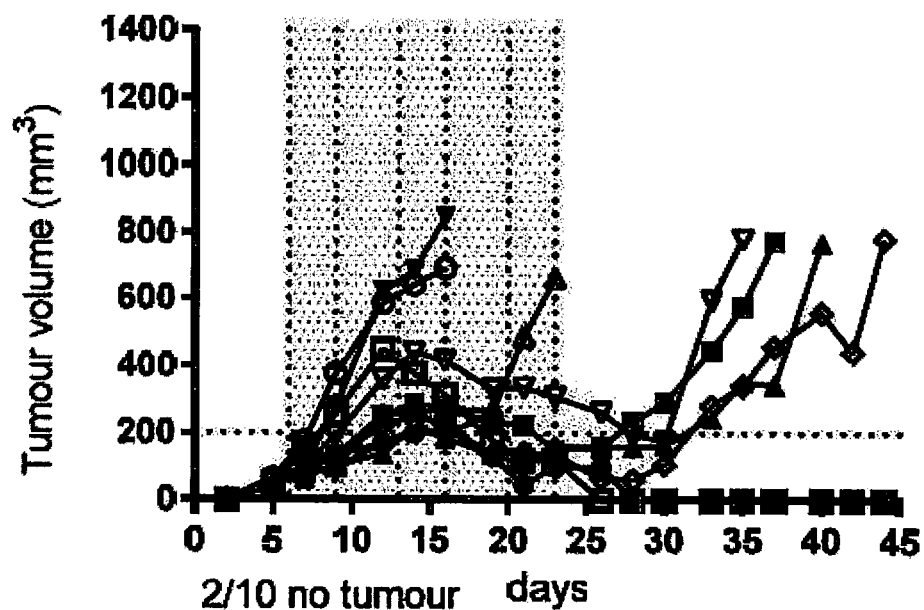
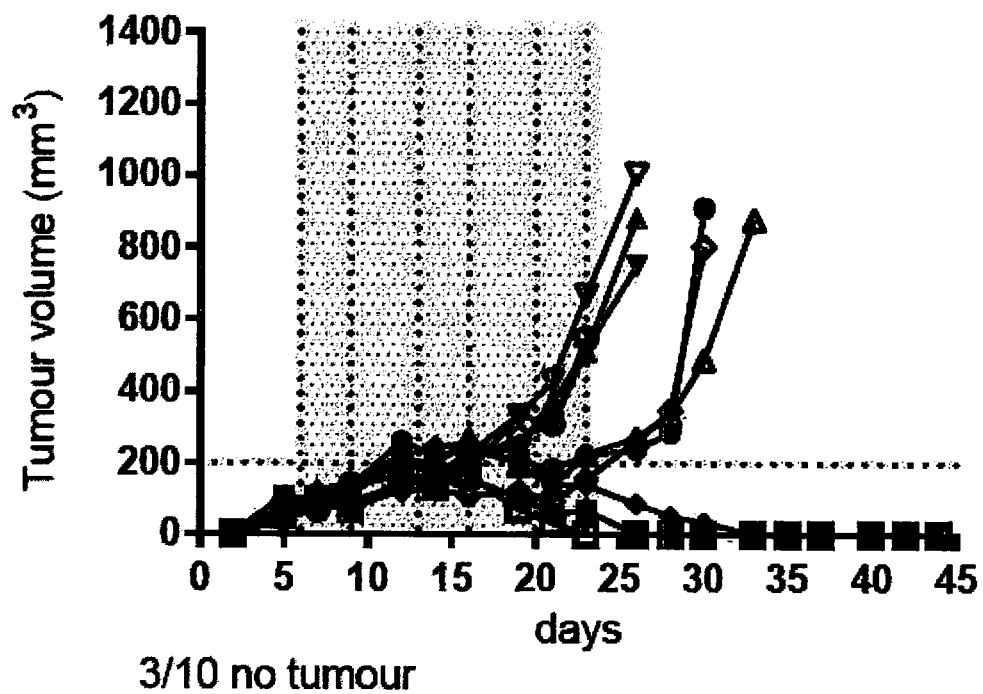
Figure 22 C and D

A) IgG1_457 LAGA
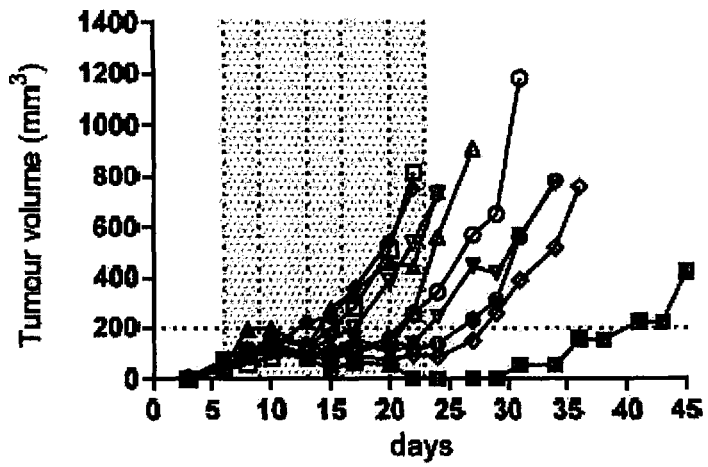
B) STIM003 + anti-PD-L1 mIgG2a
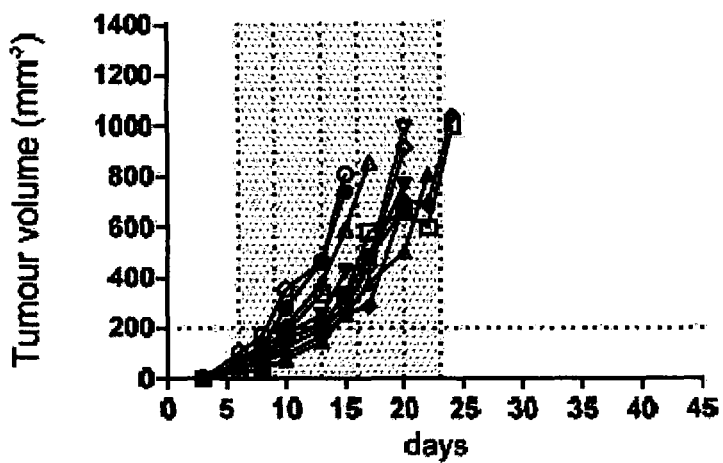
Figure 24 A and B C) STIM001_457
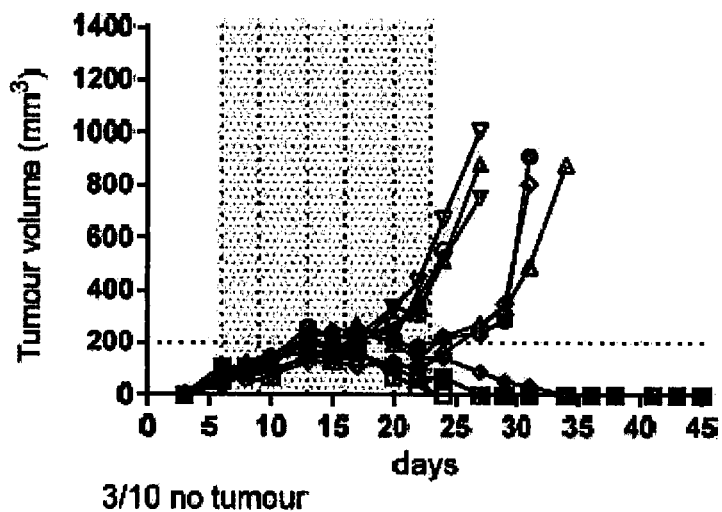
3/10 no tumour
D) STIM003_457
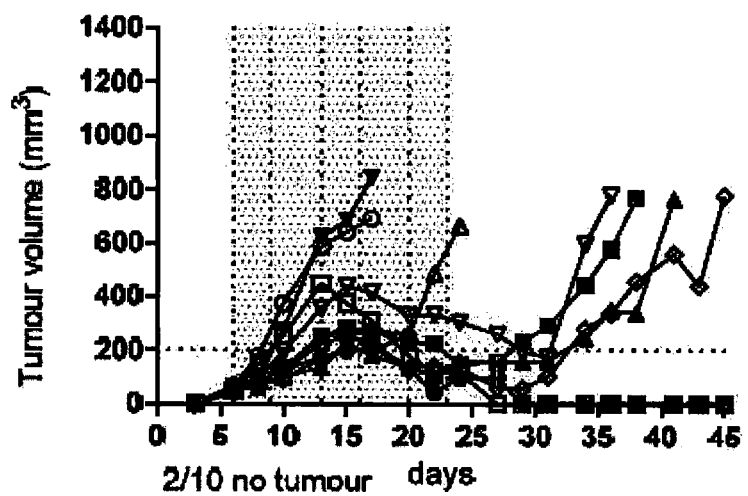
2/10 no tumour
Figure 24 C and D

BISPECIFIC ANTIBODY FOR ICOS AND PD-L1

This application is a national stage filing under 35 U.S.C. § 371 of International Application No. PCT/GB2018/053698, filed on Dec. 19, 2018, which claims priority of U.S. Provisional Application No. 62/607,469, filed Dec. 19, 2017. The contents of these applications are each incorporated herein by reference.

FIELD OF THE INVENTION

This invention relates to antigen-binding molecules that bind cell surface receptors involved in regulation of the immune response. It relates to antibodies for use in stimulating a patient's immune system, especially the effector T cell response, and has applications in the field of immuno-oncology, especially treatment of tumours. More particularly the invention relates to multi-specific antibodies that bind ICOS and PD-L1.

REFERENCE TO SEQUENCE LISTING SUBMITTED ELECTRONICALLY

An official copy of the sequence listing is submitted electronically via EFS-WEB as an ASCII formatted sequence listing with a file named 13312.0033-SEQLIST.txt, created on Sep. 30, 2020, and having a size of 631,620 bytes. The sequence listing contained in this ASCII formatted document is part of the specification and is herein incorporated by reference in its entirety.

BACKGROUND

An adaptive immune response involves activation, selection, and clonal proliferation of two major classes of lymphocytes termed T cells and B cells. After encountering an antigen, T cells proliferate and differentiate into antigen-specific effector cells, while B-cells proliferate and differentiate into antibody-secreting cells. T cell activation is a multi-step process requiring several signalling events between the T cell and an antigen-presenting cell (APC). For T cell activation to occur, two types of signals must be delivered to a resting T cell. The first type is mediated by the antigen-specific T cell receptor (TCR), and confers specificity to the immune response. The second signal, a costimulatory signal, regulates the magnitude of the response and is delivered through accessory receptors on the T cell.

A primary costimulatory signal is delivered through the activating CD28 receptor upon engagement of its ligands B7-1 or B7-2. In contrast, engagement of the inhibitory CTLA-4 receptor by the same B7-1 or B7-2 ligands results in attenuation of a T cell response. Thus, CTLA-4 signals antagonise costimulation mediated by CD28. At high antigen concentrations, CD28 costimulation overrides the CTLA-4 inhibitory effect. Temporal regulation of the CD28 and CTLA-4 expression maintains a balance between activating and inhibitory signals and ensures the development of an effective immune response, while safeguarding against the development of autoimmunity.

Programmed death-1 (PD-1) is a 50-55 kDa type I transmembrane receptor that is a member of the CD28 family. PD-1 is involved in the regulation of T-cell activation and is expressed on T cells, B cells, and myeloid cells. Two ligands for PD-1, PD ligand 1 (PD-L1) and ligand 2 (PD-L2) have been identified and have costimulatory features.

Programmed cell death 1 ligand 1 (PD-L1), also known as cluster of differentiation (CD274) or B7 homolog 1 (B7-H1), is a member of the B7 family that modulates activation or inhibition of the PD-1 receptor. The open reading frame of PD-L1 encodes a putative type 1 transmembrane protein of 290 amino acids, which includes two extracellular Ig domains (an N-terminal V-like domain and an Ig C-like domain), a hydrophobic transmembrane domain and a cytoplasmic tail of 30 amino acids. The 30 amino acid intracellular (cytoplasmic) domain contains no obvious signalling motifs, but does have a potential site for protein kinase C phosphorylation. The complete amino acid sequence for PD-L1 can be found in NCBI Reference Sequence: NP_054862.1 (SEQ ID NO: 1), which refers to many journal articles [1]. The PD-L1 gene is conserved in chimpanzee, Rhesus monkey, dog, cow, mouse, rat, chicken, and zebrafish. The murine form of PD-L1 bears 69% amino acid identity with the human form of PD-L1, and also shares a conserved structure.

In humans, PD-L1 is expressed on a number of immune cell types including activated and anergic/exhausted T cells, on naive and activated B cells, as well as on myeloid dendritic cells (DC), monocytes and mast cells. It is also expressed on non-immune cells including islets of the pancreas, Kupffer cells of the liver, vascular endothelium and selected epithelia, for example airway epithelia and renal tubule epithelia, where its expression is enhanced during inflammatory episodes. PD-L1 expression is also found at increased levels on a number of tumours, such as breast (e.g., triple negative breast cancer and inflammatory breast cancer), ovarian, cervical, colon, colorectal, lung (e.g., non-small cell lung cancer), renal (e.g., renal cell carcinoma), gastric, oesophageal, bladder, hepatocellular cancer, squamous cell carcinoma of the head and neck (SCCHN) and pancreatic cancer, melanoma and uveal melanoma.

PD-1/PD-L1 signalling is believed to serve a critical non-redundant function within the immune system by negatively regulating T cell responses. This regulation is involved in T cell development in the thymus, in regulation of chronic inflammatory responses and in maintenance of both peripheral tolerance and immune privilege. It appears that upregulation of PD-L1 may allow cancers to evade the host immune system and, in many cancers, the expression of PD-L1 is associated with reduced survival and an unfavourable prognosis. Therapeutic monoclonal antibodies that are able to block the PD-1/PD-L1 pathway may enhance anti-tumoural immune responses in patients with cancer. Published clinical data suggest a correlation between clinical responses with tumoural membranous expression of PD-L1 and a stronger correlation between lack of clinical responses and a lack of PD-L1 protein localised to the membrane [2, 3]. Thus, PD-L1 expression in tumours or tumour-infiltrating leukocytes is a candidate molecular marker for use in selecting patients for immunotherapy, for example, immunotherapy using anti-PD-L1 antibodies [4]. Patient enrichment based on surface expression of PD-L1 may significantly enhance the clinical success of treatment with drugs targeting the PD-1/PD-L1 pathway. There is also evidence of an ongoing immune response, such as the tumour infiltrating CD8+ T cells, or the presence of signature of cytokine activation, such as IFNγ.

Further evidence of PD-L1 expression and correlation to disease will emerge from the numerous ongoing clinical trials. Atezolizumab is the most advanced anti-PD-L1 antibody in development, and Phase II trials showed therapeutic effects in metastatic urothelial carcinoma and NSCLC, particularly in patients with PD-L1+ immune cells in the tumour microenvironment [5, 6]). Recent results from a Phase III trial of 1225 patients with NSCLC showed improved survival in patients taking atezolizumab, compared with chemotherapy, regardless of tumour expression of PD-L1 (Rittmeyer et al., 2017, The Lancet, 389(10066), 255-265).

Another member of the CD28 gene family, ICOS (Inducible T cell Co-Stimulator), was identified in 1999 [7]. It is a 55 kDa transmembrane protein, existing as a disulphide linked homodimer with two differentially glycosylated subunits. ICOS is exclusively expressed on T lymphocytes, and is found on a variety of T cell subsets. It is present at low levels on naïve T lymphocytes but its expression is rapidly induced upon immune activation, being upregulated in response to pro-inflammatory stimuli such as on engagement of TCR and co-stimulation with CD28 [8, 9]. ICOS plays a role in the late phase of T cell activation, memory T cell formation and importantly in the regulation of humoral responses through T cell dependent B cell responses [10, 11]. Intracellularly, ICOS binds PI3K and activates the kinases phophoinositide-dependent kinase 1 (PDK1) and protein kinase B (PKB). Activation of ICOS prevents cell death and upregulates cellular metabolism. In the absence of ICOS (ICOS knock-out) or in the presence of anti-ICOS neutralising antibodies there would be a suppression of pro-inflammatory responses.

ICOS binds to ICOS ligand (ICOSL) expressed on B-cells and antigen presenting cells (APC) [12, 13]. As a co-stimulatory molecule it serves to regulate TCR mediated immune responses and antibody responses to antigen. The expression of ICOS on T regulatory cells may be important, as it has been suggested that this cell type plays a negative role in immunosurveillance of cancer cells—there is emerging evidence for this in ovarian cancer [14]. Importantly, ICOS expression has been reported to be higher on intratumoural regulatory T cells (TRegs) compared with CD4+ and CD8+ effector cells that are present in the tumour microenvironment. Depletion of TRegs using antibodies with Fc-mediated cellular effector function has demonstrated strong anti-tumour efficacy in a pre-clinical model [15]. Mounting evidence implicates ICOS in an anti-tumour effect in both animal models as well as patients treated with immune-checkpoint inhibitors. In mice deficient in ICOS or ICOSL the anti-tumor effect of anti-CTLA4 therapy is diminished [16] while in normal mice ICOS ligand increases the effectiveness of anti-CTLA4 treatment in melanoma and prostate cancer [17]. Furthermore, in humans a retrospective study of advanced melanoma patients showed increased levels of ICOS following ipilimumab (anti-CTLA4) treatment [18]. In addition, ICOS expression is upregulated in bladder cancer patients treated with anti-CTLA4 [19]. It has also been observed that in cancer patients treated with anti-CTLA4 therapy the bulk of tumour specific IFNγ producing CD4 T-cells are ICOS positive while sustained elevation of ICOS positive CD4 T cells correlates with survival [18, 19, 20].

WO2016/120789 described anti-ICOS antibodies and proposed their use for activating T cells and for treating cancer, infectious disease and/or sepsis. A number of murine anti-ICOS antibodies were generated, of which a sub-set were reported to be agonists of the human ICOS receptor. The antibody "422.2" was selected as the lead anti-ICOS antibody and was humanised to produce a human "IgG4PE" antibody designated "H2L5". H2L5 was reported to have an affinity of 1.34 nM for human ICOS and 0.95 nM for cynomolgus ICOS, to induce cytokine production in T cells, and to upregulate T cell activation markers in conjunction with CD3 stimulation. However, mice bearing implanted human melanoma cells were reported to show only minimal tumour growth delay or increase in survival when treated with H2L5 hIgG4PE, compared with control treated group. The antibody also failed to produce significant further inhibition of tumour growth in combination experiments with ipilimumab (anti-CTLA-4) or pembrolizumab (anti-PD-1), compared with ipilimumab or pembrolizumab monotherapy. Finally, in mice bearing implanted colon cancer cells (CT26), low doses of a mouse cross reactive surrogate of H2L5 in combination with a mouse surrogate of ipilimumab or pembrolizumab only mildly improved overall survival compared with anti-CTL4 and anti-PD1 therapy alone. A similar lack of strong therapeutic benefit was shown in mice bearing implanted EMT6 cells.

WO2016/154177 described further examples of anti-ICOS antibodies. These antibodies were reported to be agonists of CD4+ T cells, including effector CD8+ T cells (TEff), and to deplete T regulator cells (TRegs). Selective effects of the antibodies on TEff vs TReg cells were described, whereby the antibodies could preferentially deplete TRegs while having minimal effect on TEffs that express a lower level of ICOS. The anti-ICOS antibodies were proposed for use in treating cancer, and combination therapy with anti-PD-1 or anti-PD-L1 antibodies was described.

Although there has been immense progress in the field of immuno-oncology in recent years, current response rates of immuno-oncology drugs remain low. For example, the response rate for the anti-PD-1 antibody nivolumab in melanoma is around 30%, and the response rate for the anti-PD-L1 atezolizumab in its Phase II clinical trial in urothelial carcinoma was around 15% overall in patients regardless of PD-L1 expression or 26% in patients with PD-L1 expressing tumours. Efforts to increase efficacy of immuno-oncology treatment have included combining multiple drugs, for example combinations of antibodies and traditional chemotherapeutic agents or radiation, and the combined use of drugs targeting different immune checkpoint inhibitors. A combination of nivolumab (anti-PD-1) and ipilimumab (anti-CTLA-4) has shown efficacy in previously untreated cases of melanoma, with headline response rates and overall survival being encouraging [21]. However, although combination therapy may generate new or enhanced biological effects in vivo, this carries an associated risk of negative drug interactions and new or worsened side-effects. Immune checkpoint inhibitor therapy is already associated with immune-related adverse events, including neurological events ranging from mild headache to life-threatening encephalitis [22]. Further, on a practical level, treatment regimens involving combinations of multiple therapeutic agents have the drawbacks of complex administration regimens and high cost.

SUMMARY OF THE INVENTION

The present invention relates to antigen-binding molecules that comprise multiple antigen-binding sites ("multispecific antigen-binding molecules"), including an antigen-binding site for human ICOS and an antigen-binding site for human PD-L1. The multispecific antibodies of the present invention are in the format known as "mAb2" or "mAb squared", which are antibodies comprising an Fc region that has been engineered to contain antigen-binding loops in its CH3 domain—this modified Fc is termed an "Fcab". The mAb2 further comprises a Fab region, comprising a VH-VL domain pair providing an antigen-binding site. mAb2 molecules of the present invention comprise a PD-L1 binding Fcab and an ICOS-binding Fab. See FIG. 3.

Accordingly, a first aspect of the present invention is a multispecific antibody comprising a Fab and an Fc region, wherein the Fab comprises an ICOS binding site and wherein the Fc region comprises a PD-L1 binding site. The PD-L1 binding site is engineered into loop regions of the CH3 domain of the Fc region. The Fc comprises a CH3 domain in which residues 14 to 18 (the "AB loop") are substituted by SGYW (SEQ ID NO: 617), residues 45.1 to 78 (the "CD loop") are substituted by EPQYWA (SEQ ID NO: 618), and residues 92 to 101 (the "EF loop") are substituted by SNWRWQLDD (SEQ ID NO: 619). Numbering is according to IMGT. See FIG. 2, which shows the CH3 domain sequence of the Fcab aligned against a wild type human IgG1 sequence, with IMGT numbering. Thus, the multispecific antibody of the present invention comprises an Fcab CH3 domain comprising PD-L1 binding site provided by structural loop sequences as follows:

AB loop SEQ ID NO: 617
CD loop SEQ ID NO: 618
EF loop SEQ ID NO: 619.

An Fc region is dimeric and thus comprises paired heavy chain constant regions each comprising a CH3 domain. The paired CH3 domains of the Fc may comprise identical AB, CD and EF loops (of sequences identified above), and optionally both CH3 domains of the Fc are identical. The Fc, and optionally the whole multispecific antibody, may be homodimeric.

The multispecific antibody preferably comprises two heavy chains and two light chains. The two heavy chains comprise paired Fc regions, and a VH and CH1 region. A full heavy chain comprises VH linked sequentially to CH1, CH2 and CH3 respectively (in N to C direction) with a hinge region between domains CH1 and CH2. A full light chain comprises a VL linked to CL (in N to C direction). Each heavy chain is paired with a light chain, wherein VH associates with VL and CH1 associates with CL. The whole antibody thus comprises two Fabs, each Fab comprising a VH-VL domain pair.

The antibody may be a mAb² comprising two ICOS-binding Fab domains and an Fc region comprising two binding sites for PD-L1 (i.e., a PD-L1 binding Fcab), as illustrated in FIG. 3.

Antibodies according to the present invention have shown interesting properties that indicate their suitability for use in therapy, offering the opportunity to treat human patients for diseases such as cancer. The antibodies may thus be provided with human heavy and light chain sequences, to minimise immunogenicity.

Thus, the Fc region is preferably a human Fc region. IgG Fc is commonly used in therapeutic molecules. The CH3 domain (and preferably the Fc as a whole) is preferably a human CH3 or human Fc that has been engineered to comprise the PD-L1 binding site. Thus, the PD-L1 binding site is provided by a CH3 domain comprising the AB, CD and EF loop sequences as indicated.

A range of antibody constant region sequences are known and the skilled person may select any to use for the multispecific antibody, engineering the structural loop region accordingly. A number of example constant regions are provided herein. It may be advantageous to use an Fc region that is effector positive, e.g., which has ADCC or CDC activity. Effector null sequences are also available. A preferred CH3 is a human IgG1 Fc CH3 domain (e.g., comprising the CH3 domain sequence of a human IgG1 sequence shown or mentioned herein). A preferred Fc is a human IgG1 Fc (e.g., comprising a human IgG1 sequence shown or mentioned herein). The multispecific antibody may comprise a CH3 domain having an amino acid sequence at least 90% identical (e.g., at least 95% identical, at least 96% identical, at least 97% identical, at least 98% identical or at least 99% identical) to SEQ ID NO: 616. The multispecific antibody may comprise a CH3 domain having amino acid sequence SEQ ID NO: 616. The multispecific antibody may comprise an Fc region having an amino acid sequence at least 90% identical (e.g., at least 95% identical, at least 96% identical, at least 97% identical, at least 98% identical or at least 99% identical) to SEQ ID NO: 620. The multispecific antibody may comprise a CH3 domain having amino acid sequence SEQ ID NO: 620.

The multispecific antibody may comprise two Fabs, which may be identical or different. One or both Fabs may bind ICOS. Where both Fabs comprise a binding site for ICOS, that binding site may be identical or different. The mAb2 molecule may thus be engineered to comprise two ICOS binding sites, wherein the two ICOS binding sites are identical or different. The two ICOS binding sites may bind the same or different epitopes of ICOS. Where the binding sites are identical, the two Fabs may comprise identical VH-VL domain pairs. Features and example sequences of anti-ICOS Fabs are described in more detail elsewhere herein. A preferred Fab comprises a VH-VL domain pair comprising the CDRs of antibody STIM003. It may comprise the STIM003 VH and/or STIM003 VL domain sequences or variants thereof as described herein. Other Fabs may be used, and a Fab of the multispecific antibody may comprise the VH and VL domain of any anti-ICOS antibody described herein. Optionally, the multispecific antibody comprises two anti-ICOS Fabs. In embodiments where non-identical Fabs are used, each Fab may be independently selected from Fabs comprising the VH and VL domains of the anti-ICOS antibodies described herein.

Both ICOS and PD-L1 are expressed following primary T cell activation. PD-L1 negatively regulates T cell activation, and inhibition of PD-L1 signalling has been clinically validated as an approach to upregulate the T cell immune response against tumour cells. In context, parallel depletion of ICOS-high Tregs and stimulation of ICOS-low effector T cells can enhance T cell activation to promote anti-tumour activity.

A multispecific antigen-binding molecule that blocks the negative regulatory activity of PD-L1 on PD1+ T cells and enhances T cell activation by delivering a positive signal through ICOS offers therapeutic potential in treating cancer and other conditions in which it is desirable to upregulate the T cell immune response. The fate of T cells in the tumour micro-environment and in tumour-draining lymph nodes is influenced by a balance of inhibitory and activatory receptors, and a molecule that binds and inhibits PD-L1 while acting as an ICOS agonist may effectively turn a negative signal (from the inhibitory PD-L1 receptor) into a positive signal (from the ICOS co-activatory receptor). The immune synapse between a T cell and an antigen-presenting cell (APC) or tumour cell can be envisaged as a receptor-dense space in which the balance of receptor occupancy determines signalling within the T cell, this receptor occupancy being governed by the identity and concentration of receptors being presented on the surface of the engaging APC/tumour cell. A multispecific molecule bearing a binding site for ICOS and a binding site for PD-L1 may act directly at this immune synapse to change the balance of signals received by T cells, shifting the balance towards activation of TEffs. Combination of anti-PD-L1 and anti-ICOS in one multispecific antigen-binding molecule, rather than separate antigen-binding molecules, provides a single agent that can act as a molecular switch. The multispecific molecule may cross-link ICOS and PD-L1 on different cells (FIG. 1).

Accordingly, further aspects of the invention relate to compositions comprising the multispecific antibody with one or more pharmaceutically acceptable excipients, optionally formulated for administration to a human patient by injection (e.g., intravenous or subcutaneous injection), for which example formulations and administration methods are disclosed. Further aspects relate to use of the antibodies in methods of treatment of the human or animal body by therapy, including treatment of cancer. Cancer treated in accordance with the present invention may be cancer that is associated with Tregs and/or that tests positive for expression of ICOS and FOXP3. The cancer may be head and neck cancer, non small cell lung cancer, cervical cancer, or another type of cancer disclosed herein.

In addition to binding its two cognate antigens, a multispecific antigen-binding molecule may incorporate other moieties such as antibody effector regions to recruit cell-killing functions, which may further tip the immune balance towards T cell activation and killing of cancer cells, e.g., via depletion of TRegs which highly express ICOS on the cell surface and/or depletion of cancer cells expressing PD-L1. A bispecific antibody binding to ICOS and PD-L1 may trigger ADCC towards PD-L1+ immunosuppressive cells (e.g., MDSC, tumour cells) and/or ADCC towards ICOS+ immunosuppressive cells (e.g., Tregs).

A multispecific antigen-binding molecule that binds ICOS and PD-L1 may increase response rates of tumours that are already responsive to PD-L1 or ICOS monotherapy, increasing the proportion of patients in whom an anti-tumour response is observed and potentially improving the level of response, reducing tumour growth and extending survival compared with monotherapy. Some tumours are unresponsive to either anti-ICOS or anti-PD-L1 antibody, but may respond to a multispecific antibody that binds ICOS and PD-L1. Anti-ICOS/anti-PD-L1 bispecific binding molecules may also be used for inducing long term memory to antigens, e.g., tumour antigens, thereby providing protection against tumour regrowth. Thus, the multispecific approach described here offers advantages in improving response rates, duration of response, and patient survival, in the context of cancer therapy. Furthermore, a multispecific antigen-binding molecule can be administered to patients using simpler treatment regimens compared with multiple separate formulations of different therapeutic agents. A number of combination therapies are described herein, including administration of the multispecific antibody to a patient who is also receiving or has received treatment with a CTLA-4 antagonist or an anti-CTLA-4 antibody (e.g., ipilimumab or tremelimumab), or with a PD-1 antagonist or an anti-PD-1 antibody (e.g., pembrolizumab, nivolumab or genolimzumab).

BRIEF DESCRIPTION OF THE DRAWINGS

FIG. 2. Alignment of amino acid sequences of CH1, CH2 and CH3 domains, numbered according to IMGT. Sequence comprising Fcab engineered to contain a binding site for PD-L1 is shown compared with wild type human IgG1 sequence. Fcab comprises PD-L1 binding site provided by loops AB (IMGT residues 14-18), CD (IMGT residues 45.1-78) and EF (IMGT residues 92-101) within the human IgG1 CH3 domain.
WT and Fcab CH1 sequence SEQ ID NO: 611
WT and Fcab CH2 sequence SEQ ID NO: 613
WT CH3 sequence SEQ ID NO: 615
Fcab CH3 sequence SEQ ID NO: 616

FIG. 4 (A) STIM001 and STIM003 mAb$^2$ binding to recombinant human ICOS protein. Data representative of three experiments. (B) STIM001 and STIM003 mAb$^2$ binding to recombinant mouse ICOS protein. Data representative of three experiments. (C) Human STIM001 and STIM003 mAb$^2$ binding to recombinant human PD-L1 protein. Data representative of three experiments. (D) Mouse STIM001 and STIM003 mAb$^2$ binding to recombinant mouse PD-L1 protein. Data representative of 3 experiments.

FIG. 5 Results of ICOS FACS binding assay described in Example 4. A) mAb$^2$ binding to human ICOS expressed on CHO cells. Data representative of 3 experiments. B) mAb$^2$ binding to mouse ICOS expressed on CHO cells. Data representative of 3 experiments.

FIG. 6 Results of human PD-L1 FACS binding assay described in Example 4. A) Human PD-L1-binding FACS with anti-human IgG detection. Binding profiles of STIM001_289, STIM003_289 and IgG1_289 anti-PD-L1 mAb$^2$s and respective mAb controls. B) Human PD-L1-binding FACS with bound human ICOS labelled AlexaFluor 647 detection. Binding profiles of STIM001_289, STIM003_289 and IgG1_289 anti-PD-L1 mAb$^2$s and respective mAb controls.

FIG. 7 Results of mouse PD-L1 FACS binding assay described in Example 4. A) Mouse PD-L1-binding FACS with anti-human IgG detection. Binding profiles of STIM001_457, STIM003_457 and IgG1_438 anti-PD-L1 mAb$^2$s and respective monospecific mAb controls. B) Mouse PD-L1-binding FACS with bound human ICOS labelled AlexaFluor 647 detection. Binding profiles of STIM001_457, STIM003_457 and IgG1_438 anti-PD-L1 mAb$^2$s and respective monospecific mAb controls.

FIG. 8 (A) Human STIM001 and STIM003 mAb$^2$ Fc engagement to human FcγRIIIa on effector cells, as described in Example 5b. Data representative of 3 experiments. (B) Mouse STIM001 and STIM003 mAb$^2$ Fc engagement to FcγRIIIa on effector cells, as described in Example 5b. Data representative of 3 experiments.

FIG. 10 A) Results of mouse ICOS-Ligand neutralisation HTRF assay with mouse ICOS receptor described in Example 6. Neutralisation profiles of STIM001_289, STIM001_457, STIM003_289 and STIM003_457 mAb². Data representative of three experiments. B) Results of human ICOS-Ligand neutralisation HTRF assay with human ICOS receptor described in Example 6. Neutralisation profiles of STIM001_289, STIM001_457, STIM003_289 and STIM003_457 mAb². Data representative of three experiments.

FIG. 11 Results of PD-L1 neutralisation assay described in Example 7. A) Human PD-L1 Neutralisation FACS to human PD1. Binding profiles of STIM001_289, STIM003_289 and IgG1_289 anti-PD-L1 mAb²s and respective mAb controls. B) Human PD-L1 Neutralisation FACS to human CD80. Binding profiles of STIM001_289, STIM003_289 and IgG1_289 anti-PD-L1 mAb²s and respective mAb controls.

FIG. 12 A) Data from mouse PD-L1 neutralisation assay (FACS) to mouse PD1 as described in Example 7. Binding profiles of STIM001_457, STIM003_457 and IgG1_438 anti-PD-L1 mAb²s and respective controls. B) Data from mouse PD-L1 neutralisation assay (FACS) to mouse CD80. Binding profiles of STIM001_457, STIM003_457 and IgG1_438 anti-PD-L1 mAb²s and respective controls.

FIG. 14 Concentration-dependent study of STIM001_289, STIM003_289 and IgG1_289 vs PD-L1 AbV effect on cytokine production by CD45RO⁺ T-cells co-culture with autologous monocytes in presence of CD3 antibody (TCR activation). In this assay, as described in Example 9, IFN-γ production is used as a read-out of the neutralisation of PD-1/PD-L1 interaction by the test antibody. All antibodies were compared to the isotype control (IgG1). Raw data of one independent donor (288) is shown in the upper panel. The basal IFN-γ levels (mono/T-cells dotted line) was used to normalise the values and calculate the fold increase in IFN-γ. In the lower panel is shown an example of data comparing the increase in IFN-γ induced at one given dose (10 nM) for all 7 donors. Each dot represents an independent donor identifiable by its number and the median is marked by a line. Significance was assessed using Friedman statistic test (*<0.05 and **<0.01).

FIG. 17 Data from CT26 in vivo efficacy study described in Example 11a. Each treatment group is represented by a "spider plot" showing the tumour size of individual animals (n=10 per groups). For each group, the number of animals cured of their disease is indicated on the bottom left of the respective graphs. Dosing was on days 6, 8, 10, 13, 15 and 17, and dosing time is indicated by the shaded area. (A) Saline; (B) IgG1_457 LAGA control; (C) STIM003_457; (D) STIM001_457.

FIG. 19 Treatment with ICOS/PD-L1 antibody results in a long-term anti-tumour memory response in animals previously cured from CT26 tumours. As described in Example 11b, mice cured from CT26 colon cancer were rechallenged s.c. in the left side of their abdomen with either 2.5×10⁵ EMT-6 cells (n=4 mice per group) or 1×10⁵ CT26 cells (n=5 mice per group). The spider plots show the tumour growth during 20 days following EMT-6 or CT26 cell inoculation.

FIG. 20 Results of A20 in vivo efficacy study described in Example 12. Each treatment group is represented by a "spider plot" showing the tumour size of individual animals (n=10 per group). For each group, the number of animals cured of their disease is indicated on the bottom left of the respective graph. Dosing was on days 8, 11, 15, 18, 22 and 25.

FIG. 22 Data from EMT6 in vivo efficacy study described in Example 13. Each treatment group is represented by a "spider plot" showing the tumour size of individual animals (n=10 per group). A) Saline B) Anti-PD-L1 mAb² control antibody C) STIM003_457 D) STIM001_457. For each group, the number of animals cured of their disease is indicated on the bottom left of the respective graph. Dosing was on days 6, 9, 13, 16, 20 and 23.

FIG. 24 Bispecific efficacy in the EMT6 model described in Example 13. A) IgG1 LAGA hybrid control mAb² antibody with anti-PD-L1 457 Fcab; B) combination of STIM003 and anti-PD-L1 antibody (mouse IgG2a format); C) STIM001_457 bispecific antibody; D) STIM003_457 bispecific antibody.

DETAILED DESCRIPTION

Antibodies

Figure 1:
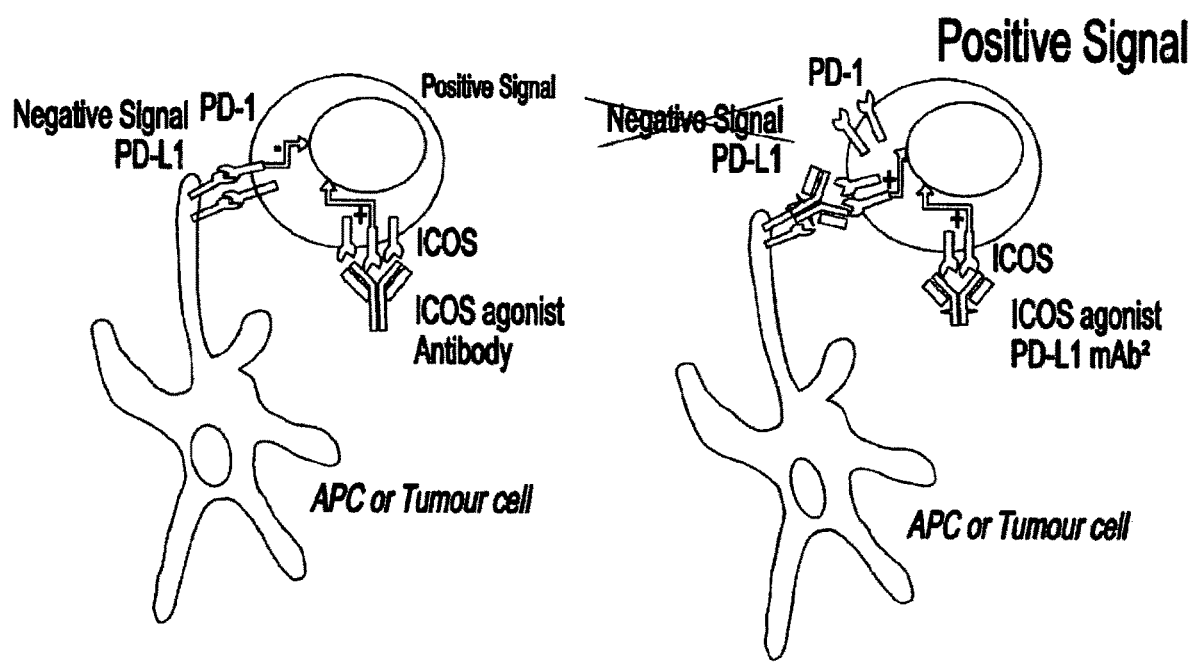
FIG. 1. Redirecting modulation of an immune checkpoint. The multispecific antigen-binding molecule effects a simultaneous blockade of PD-L1 receptors on antigen-presenting cells (APC) or tumour cells and agonism of the ICOS receptor on T effector cells, switching a negative regulatory signal to a positive regulatory signal at the T cell immune synapse.

Digestion of antibodies with the enzyme papain results in two identical antigen-binding fragments, known also as "Fab" fragments, and a "Fc" fragment, having no antigen-binding activity but having the ability to crystallize. "Fab" when used herein refers to a fragment of an antibody that includes one constant and one variable domain of each of the heavy and light chains. The term "Fc region" herein is used to define a C-terminal region of an immunoglobulin heavy chain, including native-sequence Fc regions and variant Fc regions. The "Fc fragment" refers to the carboxy-terminal portions of both H chains held together by disulfides. The effector functions of antibodies are determined by sequences in the Fc region, the region which is also recognised by Fc receptors (FcR) found on certain types of cells. Digestion of antibodies with the enzyme pepsin, results in the F(ab')2 fragment in which the two arms of the antibody molecule remain linked and comprise two-antigen binding sites. The F(ab')2 fragment has the ability to crosslink antigen.

A mAb² comprises a $V_H$ and VL domain from an intact antibody, fused to a modified constant region, which has been engineered to form an antigen-binding site, known as an "Fcab". The technology behind the Fcab/mAb² format is described in more detail in WO2008/003103, and the description of the mAb² format is incorporated herein by reference. Further descriptions of this format can be found in WO2006/072620, WO2008/003116, WO2009/000006 and WO2009/0132876.

"Fv" when used herein refers to the minimum fragment of an antibody that retains both antigen-recognition and antigen-binding sites. This region consists of a dimer of one heavy and one light chain variable domain in tight, non-covalent or covalent association. It is in this configuration that the three CDRs of each variable domain interact to define an antigen-binding site on the surface of the VH-VL dimer. Collectively, the six CDRs confer antigen-binding specificity to the antibody. However, even a single variable domain (or half of an Fv comprising only three CDRs specific for an antigen) has the ability to recognise and bind antigen, although at a lower affinity than the entire binding site.

In a Fab, an antibody antigen-binding site may be provided by one or more antibody variable domains. In an example, the antibody binding site is provided by a single variable domain, e.g., a heavy chain variable domain (VH domain) or a light chain variable domain (VL domain). In another example, the binding site comprises a VH/VL pair or two or more of such pairs. Thus, an antibody antigen-binding site may comprise a VH and a VL. An antibody normally comprises an antibody VH and/or VL domain. Isolated VH and VL domains of antibodies are also part of the invention. The antibody variable domains are the portions of the light and heavy chains of antibodies that include amino acid sequences of complementarity determining regions (CDRs; ie., CDR1, CDR2, and CDR3), and framework regions (FRs). Thus, within each of the VH and VL domains are CDRs and FRs. A VH domain comprises a set of HCDRs, and a VL domain comprises a set of LCDRs. VH refers to the variable domain of the heavy chain. VL refers to the variable domain of the light chain. Each VH and VL is typically composed of three CDRs and four FRs, arranged from amino-terminus to carboxy-terminus in the following order: FR1, CDR1, FR2, CDR2, FR3, CDR3, FR4. According to the methods used in this invention, the amino acid positions assigned to CDRs and FRs may be defined according to Kabat (Sequences of Proteins of Immunological Interest (National Institutes of Health, Bethesda, Md., 1987 and 1991)) or according to IMGT nomenclature. An antibody may comprise an antibody VH domain comprising a VH CDR1, CDR2 and CDR3 and a framework. It may alternatively or also comprise an antibody VL domain comprising a VL CDR1, CDR2 and CDR3 and a framework. Examples of antibody VH and VL domains and CDRs according to the present invention are as listed in the appended sequence listing and tables that form part of the present disclosure. The IMGT system is as described by LeFranc[23]. All VH and VL sequences, CDR sequences, sets of CDRs and sets of HCDRs and sets of LCDRs disclosed herein represent aspects and embodiments of the invention. As described herein, a "set of CDRs" comprises CDR1, CDR2 and CDR3. Thus, a set of HCDRs refers to HCDR1, HCDR2 and HCDR3, and a set of LCDRs refers to LCDR1, LCDR2 and LCDR3. Unless otherwise stated, a "set of CDRs" includes HCDRs and LCDRs.

The term "hypervariable region", "CDR region" or "CDR" refers to the regions of an antibody variable domain which are hypervariable in sequence and/or form structurally defined loops. Generally, antigen binding sites of an antibody include six hypervariable regions: three in the VH (CDRH1, CDRH2, CDRH3), and three in the VL (CDRL1, CDRL2, CDRL3). These regions of the heavy and light chains of an antibody confer antigen-binding specificity to the antibody. CDRs may be defined according to the Kabat system (see Kabat, E. A. et al., 1991, "Sequences of Proteins of Immunological Interest", 5th edit., NIH Publication no. 91-3242, U.S. Department of Health and Human Services). Other systems may be used to define CDRs, which as the system devised by Chothia et al (see Chothia, C. & Lesk, A. M., 1987, "Canonical structures for the hypervariable regions of immunoglobulins", J. Mol. Biol., 196, 901-917) and the IMGT system (see Lefranc, M. P., 1997, "Unique database numbering system for immunogenetic analysis", Immunol. Today, 18, 50). An antibody typically contains 3 heavy chain CDRs and 3 light chain CDRs. The term CDR or CDRs is used here to indicate one or several of these regions. A person skilled in the art is able to readily compare the different systems of nomenclature and determine whether a particular sequence may be defined as a CDR.

A "human antibody" is an antibody that possesses an amino-acid sequence corresponding to that of an antibody produced by a human and/or has been made using any of the techniques for making human antibodies and specifically excludes a humanized antibody comprising non-human antigen-binding residues. The term "specifically binds to" refers to measurable and reproducible interactions such as binding between a target and an antibody, which is determinative of the presence of the target in the presence of a heterogeneous population of molecules including biological molecules. For example, an antibody that specifically binds to a target (which can be an epitope) is an antibody that binds this target with greater affinity, avidity, more readily, and/or with greater duration than it binds to other targets. In one embodiment, the extent of binding of an antibody to an unrelated target is less than about 10% of the binding of the antibody to the target as measured, e.g., by a radioimmunoassay (RIA).

The term "effector function" as used herein is meant to refer to one or more of antibody dependant cell mediated cytotoxic activity (ADCC), complement-dependant cytotoxic activity (CDC) mediated responses, Fc-mediated phagocytosis or antibody dependant cellular phagocytosis (ADCP) and antibody recycling via the FcRn receptor.

The term "heavy chain" when used with reference to an antibody refers to five distinct types, called alpha (a), delta (6), epsilon (E), gamma (γ) and mu (ii), based on the amino acid sequence of the heavy chain constant domain. These distinct types of heavy chains are well known and give rise to five classes of antibodies, IgA, IgD, IgE, IgG and IgM, respectively, including four subclasses of IgG, namely IgG1, IgG1, IgG3 and IgG4. Preferably the heavy chain is a human heavy chain. In the human population, multiple heavy chain constant region alleles, of each immunoglobulin or immunoglobulin subclass, exist. The nucleotide and amino acid sequences of these allelic variants are accessible on publicly available databases such as IMGT, ENSEMBL Swiss-Prot and Uniprot. Allelic variants may also be identified in various genome sequencing projects. In one embodiment, the antibodies and antibody fragments disclosed herein comprise a heavy chain encoded by a IgG1 constant region allele, which includes, but is not limited to, human IGHG1*01 (Seq ID Nos: 340, 341 & 537), IGHG1*02 (Seq ID Nos: 340, & 341 & 537), IGHG1*03 (Seq ID Nos: 523 & 524), IGHG1*04 (Seq ID Nos: 525 & 526) and IGHG1*05 (Seq ID Nos: 340, 341 & 537). In one embodiment, the antibodies and antibody fragments disclosed herein comprise a protein encoded by a IgG2 constant region allele, which includes, but is not limited to, human IGHG2*01 (Seq ID Nos: 527 & 528), IGHG2*02 (Seq ID Nos: 529 & 530), IGHG2*03 (Seq ID Nos: 527 & 528), IGHG2*04 (Seq ID Nos: 531 & 532), IGHG2*05 (Seq ID Nos: 527 & 528) and IGHG2*06 (Seq ID Nos: 533 & 534). In one embodiment, the antibodies or antibody fragments disclosed herein comprise a protein encoded by an IgG3 constant region allele, which includes but is not limited to human IGHG3*01, IGHG3*02, IGHG3*03, IGHG3*04, IGHG3*05, IGHG3*06, IGHG3*07, IGHG3*08, IGHG3*09, IGHG3*10, IGHG3*11, IGHG3*12, IGHG3*13, IGHG3*14, IGHG3*15, IGHG3*16, IGHG3*17, IGHG3*18 and IGHG3*19. In one embodiment, the antibodies or antibody fragments disclosed herein comprise a protein encoded by a IgG4 constant region allele, which includes but is not limited to human IGHG4*01 (Seq ID Nos: 192 & 193), IGHG4*02 (Seq ID Nos: 194 & 195), IGHG4*03 (Seq ID Nos: 196 & 197) and IGHG4*04 (Seq ID Nos: 192 & 193). In another example, the heavy chain is a disabled IgG isotype, e.g. a disabled IgG4. In certain embodiments, the antibodies of the invention comprise a human gamma 4 constant region. In another embodiment, the heavy chain constant region does not bind Fc-γ receptors, and e.g. comprises a Leu235Glu mutation. In another embodiment, the heavy chain constant region comprises a Ser228Pro mutation to increase stability. In another embodiment, the heavy chain constant region is IgG4-PE (SEQ ID NO: 199). In In another embodiment, the antibodies and antibody fragments disclosed herein comprise a heavy chain constant region encoded by a murine IgG1 constant region allele, which includes but is not limited to mouse IGHG1*01 or IGHG1*02. In one embodiment, the antibodies and antibody fragments disclosed herein comprise a heavy chain constant region encoded by a murine IgG2 constant region allele, which includes, but is not limited to, mouse IGHG2A*01, IGHG2A*02, IGHG2B*01, IGHG2B*02, IGHG2C*01, IGHG2C*02 or IGHG2C*03. In one embodiment, the antibodies or antibody fragments disclosed herein comprise a protein encoded by a murine IgG3 constant region allele, which includes but is not limited to mouse IGHG3*01.

An "isolated" or "purified" antibody or protein is one that has been identified, separated and/or recovered from a component of its production environment (e.g., natural or recombinant). For example, the antibody or protein is substantially free of cellular material or other contaminating proteins from the cell or tissue source from which the antibody is derived, or substantially free of chemical precursors or other chemicals when chemically synthesized. The language "substantially free of cellular material" includes preparations of an antibody in which the antibody is separated from cellular components of the cells from which it is isolated or recombinantly produced. Thus, an antibody that is substantially free of cellular material includes preparations of antibody having less than about 30%, 20%, 10%, or 5% (by dry weight) of heterologous protein (also referred to herein as a "contaminating protein"). When the antibody is recombinantly produced, it is also preferably substantially free of culture medium, i.e., culture medium represents less than about 20%, 10%, or 5% of the volume of the protein preparation. When the antibody is produced by chemical synthesis, it is preferably substantially free of chemical precursors or other chemicals, i.e., it is separated from chemical precursors or other chemicals which are involved in the synthesis of the protein. Accordingly such preparations of the antibody have less than about 30%, 20%, 10%, 5% (by dry weight) of chemical precursors or compounds other than the antibody of interest. In a preferred embodiment, antibodies of the invention are isolated or purified.

The terms "Kabat numbering," and like terms are recognized in the art and refer to a system of numbering amino acid residues which are more variable (i.e. hypervariable) than other amino acid residues in the heavy chain variable regions of an antibody, or an antigen binding portion thereof (Kabat et al. (1971) Ann. NY Acad. Sci. 190:382-391 and, Kabat et al. (1991) Sequences of Proteins of Immunological Interest, Fifth Edition, U.S. Department of Health and Human Services, NIH Publication No. 91-3242). For the heavy chain variable region, the hypervariable region typically ranges from amino acid positions 31 to 35 for CDR1, amino acid positions 50 to 65 for CDR2, and amino acid positions 95 to 102 for CDR3.

The term "light chain" when used in reference to an antibody refers to the immunoglobulin light chains, of which there are two types in mammals, lambda (λ) and kappa (κ). Preferably, the light chain is a human light chain. Preferably the light chain constant region is a human constant region. In the human population, multiple light chain constant region alleles exist. The nucleotide and amino acid sequences of these allelic variants are accessible on publicly available databases such as IMGT, ENSEMBL, Swiss-Prot and Uniprot. In one embodiment, the antibodies or antibody fragments disclosed herein comprise a protein encoded by a human κ constant region allele, which includes, but is not limited to, IGKC*01 (Seq ID Nos:206 & 207), IGKC*02 (Seq ID Nos:208 & 209), IGKC*03 (Seq ID Nos:210 & 211), IGKC*04 (Seq ID Nos:212 & 213) and IGKC*05 (Seq ID Nos:214 & 215). In one embodiment, the antibodies or antibody fragments disclosed herein comprise a protein encoded by a human λ constant region allele, which includes but is not limited to IGLC1*01 (Seq ID Nos:216 & 217), IGLC1*02 (Seq ID Nos:218, 219 & 220), IGLC2*01 (Seq ID Nos:221, 222 & 538), IGLC2*02 (Seq ID Nos:224 & 225), IGLC2*03 (Seq ID Nos:224 & 225), IGLC3*01 (Seq ID Nos:226 & 227), IGLC3*02 (Seq ID Nos:228 & 229), IGLC3*03 (Seq ID Nos:230 & 231), IGLC3*04 (Seq ID Nos:232 & 233), IGLC6*01 (Seq ID Nos:234 & 235), IGLC7*01 (Seq ID Nos:236 & 237), IGLC7*02 (Seq ID Nos:236 & 237), IGLC7*03 (Seq ID Nos:535 & 536). In another embodiment, the antibodies and antibody fragments disclosed herein comprise a light chain constant region encoded by a mouse K constant region allele, which includes, but is not limited to, IGKC*01, IGKC*03 or IGKC*03. In another embodiment, the antibodies and antibody fragments disclosed herein comprise a light chain constant region encoded by a mouse A constant region allele, which includes, but is not limited to, IGLC1*01, IGLC2*01 or IGLC3*01.

The term "variable region" or "variable domain" refers to a portion of the light and heavy chains, typically about the amino-terminal 120 to 130 amino acids in the heavy chain and about 100 to 110 amino acids in the light chain, which differ extensively in sequence among antibodies and are used in the binding and specificity of each particular antibody for its particular antigen. The variability in sequence is concentrated in those regions called complimentarily determining regions (CDRs) while the more highly conserved regions in the variable domain are called framework regions (FR). The CDRs of the heavy chains are primarily responsible for the interaction of the antibody with antigen. In preferred embodiments, the variable region is a human variable region.

An antibody may comprise a VH domain that has at least 60, 70, 80, 85, 90, 95, 98 or 99% amino acid sequence identity with a VH domain of any of the antibodies shown in the appended sequence listing, and/or comprising a VL domain that has at least 60, 70, 80, 85, 90, 95, 98 or 99% amino acid sequence identity with a VL domain of any of those antibodies. Algorithms that can be used to calculate % identity of two amino acid sequences include e.g. BLAST, FASTA, or the Smith-Waterman algorithm, e.g. employing default parameters. Particular variants may include one or more amino acid sequence alterations (addition, deletion, substitution and/or insertion of an amino acid residue). Alterations may be made in one or more framework regions and/or one or more CDRs. Variants are optionally provided by CDR mutagenesis. The alterations normally do not result in loss of function, so an antibody comprising a thus-altered amino acid sequence may retain an ability to bind ICOS. It may retain the same quantitative binding ability as an antibody in which the alteration is not made, e.g. as measured in an assay described herein. The antibody comprising a thus-altered amino acid sequence may have an improved ability to bind ICOS.

Alteration may comprise replacing one or more amino acid residue with a non-naturally occurring or non-standard amino acid, modifying one or more amino acid residue into a non-naturally occurring or non-standard form, or inserting one or more non-naturally occurring or non-standard amino acid into the sequence. Examples of numbers and locations of alterations in sequences of the invention are described elsewhere herein. Naturally occurring amino acids include the 20 "standard" L-amino acids identified as G, A, V, L, I, M, P, F, W, S, T, N, Q, Y, C, K, R, H, D, E by their standard single-letter codes. Non-standard amino acids include any other residue that may be incorporated into a polypeptide backbone or result from modification of an existing amino acid residue. Non-standard amino acids may be naturally occurring or non-naturally occurring.

The term "variant" as used herein refers to a peptide or nucleic acid that differs from a parent polypeptide or nucleic acid by one or more amino acid or nucleic acid deletions, substitutions or additions, yet retains one or more specific functions or biological activities of the parent molecule. Amino acid substitutions include alterations in which an amino acid is replaced with a different naturally-occurring amino acid residue. Such substitutions may be classified as "conservative", in which case an amino acid residue contained in a polypeptide is replaced with another naturally occurring amino acid of similar character either in relation to polarity, side chain functionality or size. Such conservative substitutions are well known in the art. Substitutions encompassed by the present invention may also be "non-conservative", in which an amino acid residue which is present in a peptide is substituted with an amino acid having different properties, such as naturally-occurring amino acid from a different group (e.g., substituting a charged or hydrophobic amino; acid with alanine), or alternatively, in which a naturally-occurring amino acid is substituted with a non-conventional amino acid. In some embodiments amino acid substitutions are conservative. Also encompassed within the term variant when used with reference to a polynucleotide or polypeptide, refers to a polynucleotide or polypeptide that can vary in primary, secondary, or tertiary structure, as compared to a reference polynucleotide or polypeptide, respectively (e.g., as compared to a wild-type polynucleotide or polypeptide).

In some aspects, one can use "synthetic variants", "recombinant variants", or "chemically modified" polynucleotide variants or polypeptide variants isolated or generated using methods well known in the art. "Modified variants" can include conservative or non-conservative amino acid changes, as described below. Polynucleotide changes can result in amino acid substitutions, additions, deletions, fusions and truncations in the polypeptide encoded by the reference sequence. Some aspects use include insertion variants, deletion variants or substituted variants with substitutions of amino acids, including insertions and substitutions of amino acids and other molecules) that do not normally occur in the peptide sequence that is the basis of the variant, for example but not limited to insertion of ornithine which do not normally occur in human proteins. The term "conservative substitution," when describing a polypeptide, refers to a change in the amino acid composition of the polypeptide that does not substantially alter the polypeptide's activity. For example, a conservative substitution refers to substituting an amino acid residue for a different amino acid residue that has similar chemical properties (e.g., acidic, basic, positively or negatively charged, polar or nonpolar, etc.). Conservative amino acid substitutions include replacement of a leucine with an isoleucine or valine, an aspartate with a glutamate, or a threonine with a serine. Conservative substitution tables providing functionally similar amino acids are well known in the art. For example, the following six groups each contain amino acids that are conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); and 6) Phenylalanine (F), Tyrosine (Y), Tryptophan (W). (See also Creighton, Proteins, W. H. Freeman and Company (1984), incorporated by reference in its entirety.) In some embodiments, individual substitutions, deletions or additions that alter, add or delete a single amino acid or a small percentage of amino acids can also be considered "conservative substitutions" if the change does not reduce the activity of the peptide. Insertions or deletions are typically in the range of about 1 to 5 amino acids. The choice of conservative amino acids may be selected based on the location of the amino acid to be substituted in the peptide, for example if the amino acid is on the exterior of the peptide and expose to solvents, or on the interior and not exposed to solvents.

One can select the amino acid that will substitute an existing amino acid based on the location of the existing amino acid, including its exposure to solvents (i.e., if the amino acid is exposed to solvents or is present on the outer surface of the peptide or polypeptide as compared to internally localized amino acids not exposed to solvents). Selection of such conservative amino acid substitutions are well known in the art, for example as disclosed in Dordo et al, J. Mol Biol, 1999, 217, 721-739 and Taylor et al, J. Theor. Biol. 119 (1986); 205-218 and S. French and B. Robson, J. Mol. Evol. 19 (1983) 171. Accordingly, one can select conservative amino acid substitutions suitable for amino acids on the exterior of a protein or peptide (i.e. amino acids exposed to a solvent), for example, but not limited to, the following substitutions can be used: substitution of Y with F, T with S or K, P with A, E with D or Q, N with D or G, R with K, G with N or A, T with S or K, D with N or E, I with L or V, F with Y, S with T or A, R with K, G with N or A, K with R, A with S, K or P.

In alternative embodiments, one can also select conservative amino acid substitutions encompassed suitable for amino acids on the interior of a protein or peptide, for example one can use suitable conservative substitutions for amino acids is on the interior of a protein or peptide (i.e. the amino acids are not exposed to a solvent), for example but not limited to, one can use the following conservative substitutions: where Y is substituted with F, T with A or S, I with L or V, W with Y, M with L, N with D, G with A, T with A or S, D with N, I with L or V, F with Y or L, S with A or T and A with S, G, T or V. In some embodiments, non-conservative amino acid substitutions are also encompassed within the term of variants.

Antibodies disclosed herein may be modified to increase or decrease serum half-life. In one embodiment, one or more of the following mutations: T252L, T254S or T256F are introduced to increase biological half-life of the antibody. Biological half-life can also be increased by altering the heavy chain constant region $CH_1$ domain or CL region to contain a salvage receptor binding epitope taken from two loops of a $CH_2$ domain of an Fc region of an IgG, as described in U.S. Pat. Nos. 5,869,046 and 6,121,022, the modifications described therein are incorporated herein by reference. In another embodiment, the Fc hinge region of an antibody or antigen-binding fragment of the invention is mutated to decrease the biological half-life of the antibody or fragment. One or more amino acid mutations are introduced into the $CH_2$—$CH_3$ domain interface region of the Fc-hinge fragment such that the antibody or fragment has impaired Staphylococcyl protein A (SpA) binding relative to native Fc-hinge domain SpA binding. Other methods of increasing serum half-life are known to those skilled in the art. Thus, in one embodiment, the antibody or fragment is PEGylated. In another embodiment, the antibody or fragment is fused to an albumin-biding domain, e.g. an albumin binding single domain antibody (dAb). In another embodiment, the antibody or fragment is PASylated (i.e. genetic fusion of polypeptide sequences composed of PAS (XL-Protein GmbH) which forms uncharged random coil structures with large hydrodynamic volume). In another embodiment, the antibody or fragment is XTENylated®/rPEGylated (i.e. genetic fusion of non-exact repeat peptide sequence (Amunix, Versartis) to the therapeutic peptide). In another embodiment, the antibody or fragment is ELPylated (i.e. genetic fusion to ELP repeat sequence (PhaseBio)). These various half-life extending fusions are described in more detail in Strohl, BioDrugs (2015) 29:215-239, which fusions, e.g. in Tables 2 and 6, are incorporated herein by reference.

The antibody may have a modified constant region which increases stability. Thus, in one embodiment, the heavy chain constant region comprises a Ser228Pro mutation. In another embodiment, the antibodies and fragments disclosed herein comprise a heavy chain hinge region that has been modified to alter the number of cysteine residues. This modification can be used to facilitate assembly of the light and heavy chains or to increase or decrease the stability of the antibody.

Fc Effector Functions, ADCC, ADCP and CDC

As discussed above, antibodies can be provided in various isotypes and with different constant regions. The skilled person will be able to select a suitable Fc region in which to provide the described binding site for PD-L1. Examples of human IgG antibody heavy chain constant region sequences are shown herein. The Fc region of the antibody primarily determines its effector function in terms of Fc binding, antibody-dependent cell-mediated cytotoxicity (ADCC) activity, complement dependent cytotoxicity (CDC) activity and antibody-dependent cell phagocytosis (ADCP) activity. These "cellular effector functions", as distinct from effector T cell function, involve recruitment of cells bearing Fc receptors to the site of the target cells, resulting in killing of the antibody-bound cell. In addition to ADCC and CDC, the ADCP mechanism [24] represents a means of depleting antibody-bound T cells, and thus targeting high ICOS expressing TRegs for deletion.

Cellular effector functions ADCC, ADCP and/or CDC may also be exhibited by antibodies lacking Fc regions. Antibodies may comprise multiple different antigen-binding sites, one directed to ICOS and another directed to a target molecule where engagement of that target molecule induces ADCC, ADCP and/or CDC, e.g., an antibody comprising two scFv regions joined by a linker, where one scFv can engage an effector cell.

An antibody according to the present invention may be one that exhibits ADCC, ADCP and/or CDC. Alternatively, an antibody according to the present invention may lack ADCC, ADCP and/or CDC activity. In either case, an antibody according to the present invention may comprise, or may optionally lack, an Fc region that binds to one or more types of Fc receptor. Use of different antibody formats, and the presence or absence of FcR binding and cellular effector functions, allow the antibody to be tailored for use in particular therapeutic purposes as discussed elsewhere herein.

A suitable antibody format for some therapeutic applications employs a wild-type human IgG1 constant region. A constant region may be an effector-enabled IgG1 constant region, optionally having ADCC and/or CDC and/or ADCP activity. A suitable wild type human IgG1 constant region sequence is SEQ ID NO: 340 (IGHG1*01). Further examples of human IgG1 constant regions are shown herein. FIG. 2 shows the CH1, CH2 and CH3 regions of the Fc region present in the _289 mAb2 molecules used in the Examples, aligned against the corresponding domains of a human wild type IgG1 constant region. Variations of this may be made in the regions outside the binding loops AB, CD and EF, for example to alter the effector functions. Mutations (e.g., substitutions) may be made to match other immunoglobulin isotypes, or for other reasons. An example mutation is A38V, namely the substitution of valine for the alanine at IMGT residue 38.

For testing of candidate therapeutic antibodies in mouse models of human disease, an effector positive mouse constant region, such as mouse IgG2a (mIgG2a), may be included instead of an effector positive human constant region.

A constant region may be engineered for enhanced ADCC and/or CDC and/or ADCP.

The potency of Fc-mediated effects may be enhanced by engineering the Fc domain by various established techniques. Such methods increase the affinity for certain Fc-receptors, thus creating potential diverse profiles of activation enhancement. This can achieved by modification of one or several amino acid residues [25]. Human IgG1 constant regions containing specific mutations or altered glycosylation on residue Asn297 (e.g., N297Q, EU index numbering) have been shown to enhance binding to Fc receptors. Example mutations are one or more of the residues selected from 239, 332 and 330 for human IgG1 constant regions (or the equivalent positions in other IgG isotypes). An antibody may thus comprise a human IgG1 constant region having one or more mutations independently selected from N297Q, S239D, I332E and A330L (EU index numbering). A triple mutation (M252Y/S254T/T256E) may be used to enhance binding to FcRn, and other mutations affecting FcRn binding are discussed in Table 2 of [26], any of which may be employed in the present invention.

Increased affinity for Fc receptors can also be achieved by altering the natural glycosylation profile of the Fc domain by, for example, generating under fucosylated or defucosylated variants [27]. Non-fucosylated antibodies harbour a tri-mannosyl core structure of complex-type N-glycans of Fc without fucose residue. These glycoengineered antibodies that lack core fucose residue from the Fc N-glycans may exhibit stronger ADCC than fucosylated equivalents due to enhancement of FcγRIIIa binding capacity. For example, to increase ADCC, residues in the hinge region can be altered to increase binding to Fc-gamma RIII [28]. Thus, an antibody may comprise a human IgG heavy chain constant region that is a variant of a wild-type human IgG heavy chain constant region, wherein the variant human IgG heavy chain constant region binds to human Fcγ receptors selected from the group consisting of FcγRIIB and FcγRIIA with higher affinity than the wild type human IgG heavy chain constant region binds to the human Fcγ receptors. The antibody may comprise a human IgG heavy chain constant region that is a variant of a wild type human IgG heavy chain constant region, wherein the variant human IgG heavy chain constant region binds to human FcγRIIB with higher affinity than the wild type human IgG heavy chain constant region binds to human FcγRIIB. The variant human IgG heavy chain constant region can be a variant human IgG1, a variant human IgG2, or a variant human IgG4 heavy chain constant region. In one embodiment, the variant human IgG heavy chain constant region comprises one or more amino acid mutations selected from G236D, P238D, S239D, S267E, L328F, and L328E (EU index numbering system). In another embodiment, the variant human IgG heavy chain constant region comprises a set of amino acid mutations selected from the group consisting of: S267E and L328F; P238D and L328E; P238D and one or more substitutions selected from the group consisting of E233D, G237D, H268D, P271G, and A330R; P238D, E233D, G237D, H268D, P271G, and A330R; G236D and S267E; S239D and S267E; V262E, S267E, and L328F; and V264E, S267E, and L328F (EU index numbering system). The enhancement of CDC may be achieved by amino acid changes that increase affinity for C1q, the first component of the classic complement activation cascade [29]. Another approach is to create a chimeric Fc domain created from human IgG1 and human IgG3 segments that exploit the higher affinity of IgG3 for C1q [30]. Antibodies of the present invention may comprise mutated amino acids at residues 329, 331 and/or 322 to alter the C1q binding and/or reduced or abolished CDC activity. In another embodiment, the antibodies or antibody fragments disclosed herein may contain Fc regions with modifications at residues 231 and 239, whereby the amino acids are replaced to alter the ability of the antibody to fix complement. In one embodiment, the antibody or fragment has a constant region comprising one or more mutations selected from E345K, E430G, R344D and D356R, in particular a double mutation comprising R344D and D356R (EU index numbering system).

WO2008/137915 described anti-ICOS antibodies with modified Fc regions having enhanced effector function. The antibodies were reported to mediate enhanced ADCC activity as compared to the level of ADCC activity mediated by a parent antibody comprising the VH and VK domains and a wild type Fc region. Antibodies according to the present invention may employ such variant Fc regions having effector function as described therein.

ADCC activity of an antibody may be determined in an assay as described herein. ADCC activity of an anti-ICOS antibody may be determined in vitro using an ICOS positive T cell line as described herein. ADCC activity of an anti-PD-L1 antibody may be determined in vitro in an ADCC assay using PD-L1 expressing cells.

For certain applications (such as in the context of vaccination) it may be preferred to use antibodies without Fc effector function. Antibodies may be provided without a constant region, or without an Fc region—examples of such antibody formats are described elsewhere herein. Alternatively, an antibody may have a constant region which is effector null. An antibody may have a heavy chain constant region that does not bind Fcγ receptors, for example the constant region may comprise a Leu235Glu mutation (i.e., where the wild type leucine residue is mutated to a glutamic acid residue). Another optional mutation for a heavy chain constant region is Ser228Pro, which increases stability. A heavy chain constant region may be an IgG4 comprising both the Leu235Glu mutation and the Ser228Pro mutation. This "IgG4-PE" heavy chain constant region is effector null.

An alternative effector null human constant region is a disabled IgG1. A disabled IgG1 heavy chain constant region may contain alanine at position 235 and/or 237 (EU index numbering), e.g., it may be a IgG1*01 sequence comprising the L235A and/or G237A mutations ("LAGA").

A variant human IgG heavy chain constant region may comprise one or more amino acid mutations that reduce the affinity of the IgG for human FcγRIIIA, human FcγRIIA, or human FcγRI. In one embodiment, the FcγRIIB is expressed on a cell selected from the group consisting of macrophages, monocytes, B-cells, dendritic cells, endothelial cells, and activated T-cells. In one embodiment, the variant human IgG heavy chain constant region comprises one or more of the following amino acid mutations G236A, S239D, F243L, T256A, K290A, R292P, S298A, Y300L, V305I, A330L, I332E, E333A, K334A, A339T, and P396L (EU index numbering system). In one embodiment, the variant human IgG heavy chain constant region comprises a set of amino acid mutations selected from the group consisting of: S239D; T256A; K290A; S298A; I332E; E333A; K334A; A339T; S239D and I332E; S239D, A330L, and I332E; S298A, E333A, and K334A; G236A, S239D, and I332E; and F243L, R292P, Y300L, V305I, and P396L (EU index numbering system). In one embodiment, the variant human IgG heavy chain constant region comprises a S239D, A330L, or I332E amino acid mutations (EU index numbering system). In one embodiment, the variant human IgG heavy chain constant region comprises an S239D and I332E amino acid mutations (EU index numbering system). In one embodiment, the variant human IgG heavy chain constant region is a variant human IgG1 heavy chain constant region comprising the S239D and I332E amino acid mutations (EU index numbering system). In one embodiment, the antibody or fragment comprises an afucosylated Fc region. In another embodiment, the antibody or fragment thereof is defucosylated. In another embodiment, the antibody or fragment is under fucosylated.

An antibody may have a heavy chain constant region that binds one or more types of Fc receptor but does not induce cellular effector functions, i.e., does not mediate ADCC, CDC or ADCP activity. Such a constant region may be unable to bind the particular Fc receptor(s) responsible for triggering ADCC, CDC or ADCP activity.

ICOS

"ICOS" or "the ICOS receptor" referred to herein may be human ICOS, unless the context dictates otherwise. Sequences of human, cynomolgus and mouse ICOS are shown in the appended sequence listing, and are available from NCBI as human NCBI ID: NP_036224.1, mouse NCBI ID: NP_059508.2 and cynomolgus GenBank ID: EHH55098.1.

The ICOS ligand (ICOSL, also known as B7-H2) is a cell surface expressed molecule that binds to the ICOS receptor [31]. This intercellular ligand-receptor interaction promotes multimerisation of ICOS on the T cell surface, activating the receptor and stimulating downstream signalling in the T cell. In effector T cells, this receptor activation stimulates the effector T cell response.

Antibodies to ICOS

Anti-ICOS antibodies may act as agonists of ICOS, mimicking and even surpassing the stimulatory effect of the native ICOS ligand on the receptor. Such agonism may result from ability of the antibody to promote multimerisation of ICOS on the T cell. One mechanism for this is where the antibodies form intercellular bridges between ICOS on the T cell surface and receptors on an adjacent cell (e.g., B cell, antigen-presenting cell, or other immune cell), such as Fc receptors and/or receptors to which the multi-specific antibody binds. Another mechanism is where antibodies having multiple (e.g., two) antigen-binding sites (e.g., two VH-VL domain pairs) bridge multiple ICOS receptor molecules and so promote multimerisation. A combination of these mechanisms may occur.

A bispecific antibody combining both ICOS agonism with PD-L1 antagonism may act via its PD-L1 binding arm (e.g., Fcab) to inhibit the negative co-regulatory signals generated by PD-L1 expressed on APCs, myeloid-derived suppressor cells (MDSC) or tumour cells, and may instead deliver a positive agonistic signal via its ICOS binding arm (e.g., Fab). See FIG. 1.

An antibody to ICOS that acts to increase effector T cell activity represents a therapeutic approach in immunooncology and in other medical contexts where a CD8+ T cell response is beneficial. In many diseases and conditions involving an immune component, a balance exists between effector T cells (TEff) which exert the CD8+ T cell immune response, and regulatory T cells (TReg) which suppress that immune response by downregulating TEffs. The present invention relates to antibodies that modulate this TEff/TReg balance in favour of effector T cell activity. Antibodies that trigger the depletion of ICOS highly positive regulatory T cells would relieve the suppression of TEffs, and thus have a net effect of promoting the effector T cell response. An additional or complementary mechanism for an anti-ICOS antibody is via agonistic activity at the ICOS receptor level, to stimulate the effector T cell response.

The relative expression of ICOS on effector T cells (TEff) compared with regulatory T cells (TReg), and the relative activities of these cell populations, will influence the overall effect of an anti-ICOS antibody in vivo. An envisaged mode of action combines agonism of effector T cells with depletion of ICOS positive regulatory T cells. Differential and even opposing effects on these two different T cell populations may be achievable due to their different levels of ICOS expression. Dual-engineering of the variable and constant regions respectively of an anti-ICOS antibody can provide a molecule that exerts a net positive effect on effector T cell response by affecting the CD8/TReg ratio. An antigen-binding domain of an agonist antibody, which activates the ICOS receptor, may be combined with an antibody constant (Fc) region that promotes downregulation and/or clearance of highly expressing cells to which the antibody is bound. An effector positive constant region may be used to recruit cellular effector functions against the target cells (TRegs), e.g., to promote antibody-dependent cell-mediated cytotoxicity (ADCC) or antibody dependent cell phagocytosis (ADCP). A bispecific antibody binding to ICOS and PD-L1 may trigger ADCC of PD-L1+ immunosuppressive cells (e.g., MDSC, tumour cells) and ICOS+ immunosuppressive cells (Tregs). The antibody may thus act both to promote effector T cell activation and to downregulate immunosuppressive T Regulatory cells. Since ICOS is more highly expressed on TRegs than on TEffs, a therapeutic balance may be achieved whereby Teff function is promoted while TRegs are depleted, resulting in a net increase in the T cell immune response (e.g, anti-tumour response or other therapeutically beneficial T cell response).

The ICOS binding site of multi-specific antibodies described herein may bind human ICOS. The antibodies target the ICOS extracellular domain and thereby bind to T cells expressing ICOS. Examples are provided of antibodies that have been designed to have an agonistic effect on ICOS, thus enhancing the function of effector T cells, as indicated by an ability to increase IFNγ expression and secretion. As noted, anti-ICOS antibodies may also be engineered to deplete cells to which they bind, which should have the effect of preferentially downregulating regulatory T cells, lifting the suppressive effect of these cells on the effector T cell response and thus promoting the effector T cell response overall. Regardless of their mechanism of action, it is demonstrated empirically herein that anti-ICOS antibodies stimulate T cell response and have anti-tumour effects in vivo, as shown in the Examples. Through selection of appropriate antibody formats such as those including constant regions with a desired level of Fc effector function, or absence of such effector function where appropriate, the anti-ICOS antibodies may be tailored for use in a variety of medical contexts including treatment of diseases and conditions in which an effector T cell response is beneficial and/or where suppression of regulatory T cells is desired.

A multispecific antibody may comprise a Fab having a VH-VL domain pair of any anti-ICOS antibody, e.g., any anti-ICOS antibody disclosed herein. The ICOS antibodies may be any of those described in PCT/GB2017/052352 (filed 9 Aug. 2017, published as WO2018/029474), the content of which is incorporated herein by reference. Exemplary antibodies include STIM001, STIM002, STIM002-B, STIM003, STIM004, STIM005, STIM006, STIM007, STIM008 and STIM009, the sequences of which are set out herein. Numerous further example anti-ICOS antibody sequences are also disclosed herein, including in the Tables. The Fab of the multispecific antibody in the present invention may comprise a VH domain and/or a VL domain having the CDRs of any such anti-ICOS antibody, and may comprise the VH and/or VL domain sequence of that antibody.

The anti-ICOS antibody may be one that competes for binding to human ICOS with an antibody (e.g., human IgG1, or an scFv) comprising the heavy and light chain complementarity determining regions (CDRs) of STIM001, STIM002, STIM002-B, STIM003, STIM004, STIM005, STIM006, STIM007, STIM008 or STIM009, optionally an antibody comprising the VH and VL domains of STIM001, STIM002, STIM002-B, STIM003, STIM004, STIM005, STIM006, STIM007, STIM008 or STIM009.

The anti-ICOS antibody comprise one or more CDRs of any of STIM001, STIM002, STIM002-B, STIM003, STIM004, STIM005, STIM006, STIM007, STIM008 and STIM009 (e.g., all 6 CDRs of any such antibody, or a set of HCDRs and/or LCDRs) or variants thereof as described herein.

The antibody may comprise an antibody VH domain comprising CDRs HCDR1, HCDR2 and HCDR3 and an antibody VL domain comprising CDRs LCDR1, LCDR2 and LCDR3, wherein the HCDR3 is an HCDR3 of an antibody selected from STIM001, STIM002, STIM002-B, STIM003, STIM004, STIM005, STIM006, STIM007, STIM008 and STIM009 or comprises that HCDR3 with 1, 2, 3, 4 or 5 amino acid alterations. The HCDR2 may be the HCDR2 of the selected antibody or it may comprise that HCDR2 with 1, 2, 3, 4 or 5 amino acid alterations. The HCDR1 may be the HCDR1 of the selected antibody or it may comprise that HCDR1 with 1, 2, 3, 4 or 5 amino acid alterations.

The antibody may comprise an antibody VL domain comprising CDRs HCDR1, HCDR2 and HCDR3 and an antibody VL domain comprising CDRs LCDR1, LCDR2 and LCDR3, wherein the LCDR3 is an LCDR3 of an antibody selected from STIM001, STIM002, STIM002-B, STIM003, STIM004, STIM005, STIM006, STIM007, STIM008 and STIM009 or comprises that LCDR3 with 1, 2, 3, 4 or 5 amino acid alterations. The LCDR2 may be the LCDR2 of the selected antibody or it may comprise that LCDR2 with 1, 2, 3, 4 or 5 amino acid alterations. The LCDR1 may be the LCDR1 of the selected antibody or it may comprise that LCDR1 with 1, 2, 3, 4 or 5 amino acid alterations.

An antibody may comprise:

an antibody VH domain comprising complementarity determining regions HCDR1, HCDR2 and HCDR3, and an antibody VL domain comprising complementarity determining regions LCDR1, LCDR2 and LCDR3, wherein the heavy chain complementarity determining regions are those of STIM001, STIM002, STIM002-B, STIM003, STIM004, STIM005, STIM006, STIM007, STIM008 or STIM009 or comprise the STIM001, STIM002, STIM002-B, STIM003, STIM004 or STIM005, STIM006, STIM007, STIM008 or STIM009 heavy chain complementarity determining regions with 1, 2, 3, 4 or 5 amino acid alterations; and/or wherein the light chain complementarity determining regions are those of antibody STIM001, STIM002, STIM002-B, STIM003, STIM004, STIM005, STIM006, STIM007, STIM008 or STIM009, or comprise the STIM001, STIM002, STIM002-B, STIM003, STIM004, STIM005, STIM006, STIM007, STIM008 or STIM009 light chain complementarity determining regions with 1, 2, 3, 4 or 5 amino acid alterations.

An antibody may comprise a VH domain comprising a set of heavy chain complementarity determining regions (HCDRs) HCDR1, HCDR2 and HCDR3, wherein HCDR1 is the HCDR1 of STIM003, HCDR2 is the HCDR2 of STIM003, HCDR3 is the HCDR3 of STIM003, or comprising that set of HCDRs with 1, 2, 3, 4, 5 or 6 amino acid alterations.

An antibody may comprise a VL domain comprising a set of light chain complementarity determining regions (LCDRs) LCDR1, LCDR2 and LCDR3, wherein LCDR1 is the LCDR1 of STIM003, LCDR2 is the LCDR2 of STIM003, LCDR3 is the LCDR3 of STIM003, or comprising that set of LCDRs with 1, 2, 3 or 4 amino acid alterations.

Amino acid alterations (e.g., substitutions) may be at any residue position in the CDRs. Examples of amino acid alterations are those illustrated in FIG. 35, FIG. 36 and FIG. 37, which show alignments of variant sequences of anti-ICOS antibodies. Thus, an amino acid alteration in a STIM003 CDR may be a substitution of the residue present at the corresponding position in antibody CL-74570 or antibody CL-71642 as indicated in FIG. 36.

Example amino acid alterations in STIM003 CDRs are substitutions at the following residue positions, defined according to IMGT:

In HCDR1, substitution at IMGT position 28, optionally a conservative substitution, e.g., V28F.

In HCDR2, substitution at IMGT position 59, 63 and/or 64. Optionally the substitution at position 59 is N59I, the substitution at position 63 is G63D and/or the substitution at position 64 is D64N and/or D64S.

In HCDR3, substitution at IMGT position 106, 108, 109 and/or 112. Optionally the substitution at position 106 is R106A, the substitution at position 108 is F108Y, the substitution at position 109 is Y109F and/or the substitution at position 112 is H112N.

In LCDR1, substitution at position 36, e.g., R36S.

In LCDR3, substitution at position 105, 108 and/or 109. Optionally the substitution at position 105 is H105Q, the substitution at position 108 is D108G and/or the substitution at position 109 is M109N or M109S.

Antibodies of the invention may comprise VH and/or VL domain framework regions corresponding to human germline gene segment sequences. For example, it may comprise one or more framework regions of STIM001, STIM002, STIM002-B, STIM003, STIM004, STIM005, STIM006, STIM007, STIM008 or STIM009. The framework region or framework regions may be a FR1, FR2, FR3 and/or FR4.

An antibody of the invention may comprise an antibody VH domain which (i) is derived from recombination of a human heavy chain V gene segment, a human heavy chain D gene segment and a human heavy chain J gene segment, wherein the V segment is IGHV1-18 (e.g., V1-18*01), IGVH3-20 (e.g. V3-20*d01), IGVH3-11 (e.g, V3-11*01) or IGVH2-5 (e.g., V2-5*10);

the D gene segment is IGHD6-19 (e.g., IGHD6-19*01), IGHD3-10 (e.g., IGHD3-10*01) or IGHD3-9 (e.g., IGHD3-9*01); and/or the J gene segment is IGHJ6 (e.g., IGHJ6*02), IGHJ4 (e.g., IGHJ4*02) or IGHJ3 (e.g., IGHJ3*02), or (ii) comprises framework regions FR1, FR2, FR3 and FR4, wherein FR1 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, FR2 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, FR3 aligns with human germline V gene segment IGHV1-18 (e.g., V1-18*01), IGVH3-20 (e.g. V3-20*d01), IGVH3-11 (e.g, V3-11*01) or IGVH2-5 (e.g., V2-5*10), optionally with 1, 2, 3, 4 or 5 amino acid alterations, and/or FR4 aligns with human germline J gene segment IGJH6 (e.g., JH6*02), IGJH4 (e.g., JH4*02) or IGJH3 (e.g., JH3*02), optionally with 1, 2, 3, 4 or 5 amino acid alterations.

FR1, FR2 and FR3 of the VH domain typically align with the same germline V gene segment. Thus, for example, the antibody may comprise a VH domain derived from recombination of human heavy chain V gene segment IGHV3-20 (e.g., VH3-20*d01), a human heavy chain D gene segment and a human heavy chain J gene segment IGJH4 (e.g., JH4*02). An antibody may comprise VH domain framework regions FR1, FR2, FR3 and FR4, wherein FR1, FR2 and FR3 each align with human germline V gene segment IGHV3-20 (e.g., IGVH3-20*d01) with up to 1, 2, 3, 4 or 5 amino acid alterations, and a FR4 that aligns with human germline J gene segment IGHJ4 (e.g., IGHJ4*02) with up to 1, 2, 3, 4 or 5 amino acid alterations. Alignment may be exact, but in some cases one or more residues can be mutated from germline, so there may be amino acid substitutions present, or in rarer cases deletions or insertions.

An antibody of the invention may comprise an antibody VL domain which (i) is derived from recombination of a human light chain V gene segment and a human light chain J gene segment, wherein the V segment is IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), and/or the J gene segment is IGKJ4 (e.g., IGKJ4*01), IGKJ2 (e.g., IGKJ2*04), IGLJ3 (e.g., IGKJ3*01) or IGKJ1 (e.g., IGKJ1*01); or (ii) comprises framework regions FR1, FR2, FR3 and FR4, wherein FR1 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR2 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, FR3 aligns with human germline V gene segment IGKV2-28 (e.g., IGKV2-28*01), IGKV3-20 (e.g., IGKV3-20*01), IGKV1D-39 (e.g., IGKV1D-39*01) or IGKV3-11 (e.g., IGKV3-11*01), optionally with 1, 2, 3, 4 or 5 amino acid alterations, and/or FR4 aligns with human germline J gene segment IGKJ4 (e.g., IGKJ4*01), IGKJ2 (e.g., IGKJ2*04), IGKJ3 (e.g., IGKJ3*01) or IGKJ1 (e.g., IGKJ1*01), optionally with 1, 2, 3, 4 or 5 amino acid alterations.

FR1, FR2 and FR3 of the VL domain typically align with the same germline V gene segment. Thus, for example, the antibody may comprise a VL domain derived from recombination of human light chain V gene segment IGKV3-20 (e.g., IGKV3-20*01) and human light chain J gene segment IGKJ3 (e.g., IGKJ3*01). An antibody may comprise VL domain framework regions FR1, FR2, FR3 and FR4, wherein FR1, FR2 and FR3 each align with human germline V gene segment IGKV3-20 (e.g., IGKV3-20*01) with up to 1, 2, 3, 4 or 5 amino acid alterations, and a FR4 that aligns with human germline J gene segment IGKJ3 (e.g., IGKJ3*01) with up to 1, 2, 3, 4 or 5 amino acid alterations. Alignment may be exact, but in some cases one or more residues can be mutated from germline, so there may be amino acid substitutions present, or in rarer cases deletions or insertions.

An antibody according to the invention may comprise an antibody VH domain which is the VH domain of STIM001, STIM002, STIM002-B, STIM003, STIM004 or STIM005, STIM006, STIM007, STIM008 or STIM009, or which has an amino acid sequence at least 90% identical to the antibody VH domain sequence of STIM001, STIM002, STIM002-B, STIM003, STIM004, STIM005, STIM006, STIM007, STIM008 or STIM009. The amino acid sequence identity may be at least 95%.

The antibody may comprise an antibody VL domain which is the VL domain of STIM001, STIM002, STIM002-B, STIM003, STIM004 or STIM005, STIM006, STIM007, STIM008 or STIM009, or which has an amino acid sequence at least 90% identical to the antibody VL domain sequence of STIM001, STIM002, STIM002-B, STIM003, STIM004, STIM005, STIM006, STIM007, STIM008 or STIM009. The amino acid sequence identity may be at least 95%.

An antibody VH domain having the HCDRs of STIM001, STIM002, STIM002-B, STIM003, STIM004, STIM005, STIM006, STIM007, STIM008 or STIM009, or having a variant of those CDRs, may be paired with an antibody VL domain having the LCDRs of the same antibody, or having a variant of those CDRs. Similarly, the VH domain of any of STIM001, STIM002, STIM002-B, STIM003, STIM004, STIM005, STIM006, STIM007, STIM008 or STIM009, or a variant of that VH domain, may be paired with a VL domain of the same antibody, or a VL domain variant of the same antibody.

For instance, the antibody may comprise the antibody STIM001 VH domain and the STIM001 VL domain. In another example, the antibody may comprise the antibody STIM002 VH domain and the STIM002 VL domain. In another example, the antibody may comprise the antibody STIM003 VH domain and the STIM003 VL domain.

STIM001 has a heavy chain variable region ($V_H$) amino acid sequence of Seq ID No:366, comprising the CDRH1 amino acid sequence of Seq ID No:363, the CDRH2 amino acid sequence of Seq ID No:364, and the CDRH3 amino acid sequence of Seq ID No:365. The heavy chain nucleic acid sequence of the $V_H$ domain is Seq ID No:367. STIM001 has a light chain variable region ($V_L$) amino acid sequence of Seq ID No:373, comprising the CDRL1 amino acid sequence of Seq ID No:370, the CDRL2 amino acid sequence of Seq ID No:371, and the CDRL3 amino acid sequence of Seq ID No:372. The light chain nucleic acid sequence of the $V_L$ domain is Seq ID No:374. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:368 (heavy chain nucleic acid sequence Seq ID No:369). A full length light chain amino acid sequence is Seq ID No:375 (light chain nucleic acid sequence Seq ID No:376).

STIM002 has a heavy chain variable region ($V_H$) amino acid sequence of Seq ID No:380, comprising the CDRH1 amino acid sequence of Seq ID No:377, the CDRH2 amino acid sequence of Seq ID No:378, and the CDRH3 amino acid sequence of Seq ID No:379. The heavy chain nucleic acid sequence of the $V_H$ domain is Seq ID No:381. STIM002 has a light chain variable region ($V_L$) amino acid sequence of Seq ID No:387, comprising the CDRL1 amino acid sequence of Seq ID No:384, the CDRL2 amino acid sequence of Seq ID No:385, and the CDRL3 amino acid sequence of Seq ID No:386. The light chain nucleic acid sequence of the $V_L$ domain is Seq ID No:388 or Seq ID No:519. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:382 (heavy chain nucleic acid sequence Seq ID No:383). A full length light chain amino acid sequence is Seq ID No:389 (light chain nucleic acid sequence Seq ID No:390 or Seq ID NO:520).

STIM002-B has a heavy chain variable region ($V_H$) amino acid sequence of Seq ID No:394, comprising the CDRH1 amino acid sequence of Seq ID No:391, the CDRH2 amino acid sequence of Seq ID No:392, and the CDRH3 amino acid sequence of Seq ID No:393. The heavy chain nucleic acid sequence of the $V_H$ domain is Seq ID No:395. STIM002-B has a light chain variable region ($V_L$) amino acid sequence of Seq ID No:401, comprising the CDRL1 amino acid sequence of Seq ID No:398, the CDRL2 amino acid sequence of Seq ID No:399, and the CDRL3 amino acid sequence of Seq ID No:400. The light chain nucleic acid sequence of the $V_L$ domain is Seq ID No:402. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:396 (heavy chain nucleic acid sequence Seq ID No:397). A full length light chain amino acid sequence is Seq ID No:403 (light chain nucleic acid sequence Seq ID No:404).

STIM003 has a heavy chain variable region ($V_H$) amino acid sequence of Seq ID No:408, comprising the CDRH1 amino acid sequence of Seq ID No:405, the CDRH2 amino acid sequence of Seq ID No:406, and the CDRH3 amino acid sequence of Seq ID No:407. The heavy chain nucleic acid sequence of the $V_H$ domain is Seq ID No:409 or Seq ID No:521. STIM003 has a light chain variable region ($V_L$) amino acid sequence of Seq ID No:415, comprising the CDRL1 amino acid sequence of Seq ID No:412, the CDRL2 amino acid sequence of Seq ID No:413, and the CDRL3 amino acid sequence of Seq ID No:414. The light chain nucleic acid sequence of the $V_L$ domain is Seq ID No:4416. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:410 (heavy chain nucleic acid sequence Seq ID No:411 or Seq ID No:522). A full length light chain amino acid sequence is Seq ID No:417 (light chain nucleic acid sequence Seq ID No:418).

STIM004 has a heavy chain variable region ($V_H$) amino acid sequence of Seq ID No:422, comprising the CDRH1 amino acid sequence of Seq ID No:419, the CDRH2 amino acid sequence of Seq ID No:420, and the CDRH3 amino acid sequence of Seq ID No:421. The heavy chain nucleic acid sequence of the $V_H$ domain is Seq ID No:423. STIM004 has a light chain variable region ($V_L$) amino acid sequence of Seq ID No:429, comprising the CDRL1 amino acid sequence of Seq ID No:426, the CDRL2 amino acid sequence of Seq ID No:427, and the CDRL3 amino acid sequence of Seq ID No:428. The light chain nucleic acid sequence of the $V_L$ domain is Seq ID No:430 or Seq ID No:431. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:424 (heavy chain nucleic acid sequence Seq ID No:425). A full length light chain amino acid sequence is Seq ID No:432 (light chain nucleic acid sequence Seq ID No:433 or Seq ID no: 434).

STIM005 has a heavy chain variable region ($V_H$) amino acid sequence of Seq ID No:438, comprising the CDRH1 amino acid sequence of Seq ID No:435, the CDRH2 amino acid sequence of Seq ID No:436, and the CDRH3 amino acid sequence of Seq ID No:437. The heavy chain nucleic acid sequence of the $V_H$ domain is Seq ID No:439. STIM005 has a light chain variable region ($V_L$) amino acid sequence of Seq ID No:445, comprising the CDRL1 amino acid sequence of Seq ID No:442, the CDRL2 amino acid sequence of Seq ID No:443, and the CDRL3 amino acid sequence of Seq ID No:444. The light chain nucleic acid sequence of the $V_L$ domain is Seq ID No:446. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:440 (heavy chain nucleic acid sequence Seq ID No:441). A full length light chain amino acid sequence is Seq ID No:447 (light chain nucleic acid sequence Seq ID No:448).

STIM006 has a heavy chain variable region ($V_H$) amino acid sequence of Seq ID No:452, comprising the CDRH1 amino acid sequence of Seq ID No:449, the CDRH2 amino acid sequence of Seq ID No:450, and the CDRH3 amino acid sequence of Seq ID No:451. The heavy chain nucleic acid sequence of the $V_H$ domain is Seq ID No:453. STIM006 has a light chain variable region ($V_L$) amino acid sequence of Seq ID No:459, comprising the CDRL1 amino acid sequence of Seq ID No:456, the CDRL2 amino acid sequence of Seq ID No:457, and the CDRL3 amino acid sequence of Seq ID No:458. The light chain nucleic acid sequence of the $V_L$ domain is Seq ID No:460. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:454 (heavy chain nucleic acid sequence Seq ID No:455). A full length light chain amino acid sequence is Seq ID No:461 (light chain nucleic acid sequence Seq ID No:462).

STIM007 has a heavy chain variable region ($V_H$) amino acid sequence of Seq ID No:466, comprising the CDRH1 amino acid sequence of Seq ID No:463, the CDRH2 amino acid sequence of Seq ID No:464, and the CDRH3 amino acid sequence of Seq ID No:465. The heavy chain nucleic acid sequence of the $V_H$ domain is Seq ID No:467. STIM007 has a light chain variable region ($V_L$) amino acid sequence of Seq ID No:473, comprising the CDRL1 amino acid sequence of Seq ID No:470, the CDRL2 amino acid sequence of Seq ID No:471, and the CDRL3 amino acid sequence of Seq ID No:472. The light chain nucleic acid sequence of the $V_L$ domain is Seq ID No:474. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:468 (heavy chain nucleic acid sequence Seq ID No:469). A full length light chain amino acid sequence is Seq ID No:475 (light chain nucleic acid sequence Seq ID No:476).

STIM008 has a heavy chain variable region ($V_H$) amino acid sequence of Seq ID No:480, comprising the CDRH1 amino acid sequence of Seq ID No:477, the CDRH2 amino acid sequence of Seq ID No:478, and the CDRH3 amino acid sequence of Seq ID No:479. The heavy chain nucleic acid sequence of the $V_H$ domain is Seq ID No:481. STIM008 has a light chain variable region ($V_L$) amino acid sequence of Seq ID No:487, comprising the CDRL1 amino acid sequence of Seq ID No:484, the CDRL2 amino acid sequence of Seq ID No:485, and the CDRL3 amino acid sequence of Seq ID No:486. The light chain nucleic acid sequence of the $V_L$ domain is Seq ID No:488. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:482 (heavy chain nucleic acid sequence Seq ID No:483). A full length light chain amino acid sequence is Seq ID No:489 (light chain nucleic acid sequence Seq ID No:490).

STIM009 has a heavy chain variable region ($V_H$) amino acid sequence of Seq ID No:494, comprising the CDRH1 amino acid sequence of Seq ID No:491, the CDRH2 amino acid sequence of Seq ID No:492, and the CDRH3 amino acid sequence of Seq ID No:493. The heavy chain nucleic acid sequence of the $V_H$ domain is Seq ID No:495. STIM009 has a light chain variable region ($V_L$) amino acid sequence of Seq ID No:501, comprising the CDRL1 amino acid sequence of Seq ID No:498, the CDRL2 amino acid sequence of Seq ID No:499, and the CDRL3 amino acid sequence of Seq ID No:500. The light chain nucleic acid sequence of the $V_L$ domain is Seq ID No:502. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:496 (heavy chain nucleic acid sequence Seq ID No:497). A full length light chain amino acid sequence is Seq ID No:503 (light chain nucleic acid sequence Seq ID No:504).

The sequences of these and other anti-ICOS antibodies are shown in the Tables. Antibodies STIM001-009 are described in more detail in PCT/GB2017/052352 (WO2018/029474) filed 9 Aug. 2017.

Further exemplary anti-ICOS antibodies include those described in GB patent application no 1721338.0 filed 19 Dec. 2017 and the corresponding international patent application claiming priority from it and filed on 19 Dec. 2018 entitled "Antibodies to ICOS". An antibody according to the present invention may comprise an anti-ICOS Fab in which the VH and/or VL domain is the VH and/or VL domain of any anti-ICOS antibody described therein, including any of STIM017, STIM020, STIM021, STIM022, STIM023, STIM039, STIM040, STIM041, STIM042, STIM043, STIM044, STIM050, STIM051, STIM052, STIM053, STIM054, STIM055, STIM056, STIM057, STIM058, STIM059, STIM060, STIM061, STIM062, STIM063, STIM064, STIM065 and STIM066, or a variant thereof. The VH and VL domain sequences of these antibodies are incorporated herein by reference.

In further embodiments, the VH and/or VL domain of the anti-ICOS Fab may be any VH and/or VL domain:

a. of the antibody 7F12, 37A10, 35A9, 36E10, 16G10, 37A10S713, 37A10S714, 37A10S715, 37A10S716, 37A10S717, 37A10S718, 16G10S71, 16G10S72, 16G10S73, 16G10S83, 35A9S79, 35A9S710, 35A9S89 or any other antibody described in WO2016/154177 and US2016/0304610;

b. of the antibody 422.2, H2L5, or any other antibody described in WO2016/120789 and US2016/0215059;

c. of the antibody 314-8, the antibody produced from hybridoma CNCM I-4180, or any other antibody described in WO2014/033327 and US2015/0239978;

d. of the antibody Icos145-1, the antibody produced by hybridoma CNCM I-4179, or any other antibody described in WO2012/131004, U.S. Pat. No. 9,376,493 and US2016/0264666;

e. of the antibody JMAb 136, "136", or any other antibody described in WO2010/056804;

f. of the antibody MIC-944, 9F3 or any other antibody described in WO99/15553, U.S. Pat. Nos. 7,259,247, 7,132,099, 7,125,551, 7,306,800, 7,722,872, WO05/103086, US8.318.905 and U.S. Pat. No. 8,916,155;

g. of any JMAb antibody, e.g., any of JMAb-124, JMAb-126, JMAb-127, JMAb-128, JMAb-135, JMAb-136, JMAb-137, JMAb-138, JMAb-139, JMAb-140, JMAb-141, e.g., JMAb136, or any other antibody described in WO98/3821, U.S. Pat. No. 7,932,358B2, US2002/156242, U.S. Pat. Nos. 7,030,225, 7,045,615, 7,279,560, 7,226,909, 7,196,175, 7,932,358, 8,389,690, WO02/070010, U.S. Pat. Nos. 7,438,905, 7,438,905, WO01/87981, U.S. Pat. Nos. 6,803,039, 7,166,283, 7,988,965, WO01/15732, U.S. Pat. Nos. 7,465,445 and 7,998,478;

h. of the antibody 17G9 or any other antibody described in WO2014/08911;

i. of any antibody described in WO2012/174338;

j. of any antibody described in US2016/0145344;

k. of any antibody described in WO2011/020024, US2016/002336, US2016/024211 and U.S. Pat. No. 8,840,889; or l. of any antibody described in U.S. Pat. No. 8,497,244;

m. of the antibody known as GSK3359609;

n. of the antibody known as JTX-2011;

o. of antibody clone ISA-3 (eBioscience), clone SP98 (Novus Biologicals), clone 1 G1, clone 3G4 (Abnova Corporation), clone 669222 (R&D Systems), clone TQ09 (Creative Diagnostics), or clone C398.4A (BioLegend); or p. of the hamster antibody C398.4 or a humanised antibody thereof as described in WO2018/187613 or US2018/0289790, e.g., ICOS.33 IgG1f S267E. Other examples include ICOS.4, ICOS34 G1f, ICOS35 G1f, 17C4, 9D5, 3E8, 1D7a, 1D7b and 2644. The antibody sequences are summarised in Table 35 therein;

The VH and VL domain sequences of these antibodies are incorporated herein by reference. An anti-ICOS Fab of the present invention may comprise the CDRs of any such VH and/or VL domain.

Targeting Other Antigens

A multispecific antibody may bind further target antigens in addition to ICOS and PD-L1 and/or it may be combined with one or more other antibodies that bind further target antigens. Optionally, the multispecific antibody comprises two Fabs, wherein one Fab comprises a binding site for ICOS and wherein the other Fab comprises a binding site for another target antigen.

The further target antigen may be selected from immune checkpoint inhibitors (such as PD-1, CTLA-4, TIGIT, TIM-3, LAG-3 and VISTA, e.g. TIGIT, TIM-3 and LAG-3), immune modulators (such as BTLA, hHVEM, CSF1R, CCR4, CD39, CD40, CD73, CD96, CXCR2, CXCR4, CD200, GARP, SIRPα, CXCL9, CXCL10, CXCL11 and CD155, e.g. GARP, SIRPα, CXCR4, BTLA, hVEM and CSF1R), immune activators (such as CD137, GITR, OX40, CD40, CXCR3 (e.g. agonistic anti-CXCR3 antibodies), CD27, and CD3.

The second Fab of the multispecific antibody, or the additional antibody that is used in combination with the multispecific antibody, may alternatively comprise a binding site for PD-L1, and a number of exemplary anti-PD-L1 antibodies are described herein.

In one embodiment, the PD-L1 antigen-binding site comprises the CDRH1, CDRH2, CDR3, CDRL1, CDRL2 and CDRL3, or the $V_H$, or the $V_L$ or the $V_H$ and $V_L$ region from any one of the anti-PD-L1 antibodies selected from atezolizumab (Roche), avelumab (Merck), BMS-936559/MDX-1105 (BMS), durvalumab/Medi4736 (Medimmune), KN-035, CA-170, FAZ-053, M7824, ABBV-368, LY-3300054, GNS-1480, YW243.55.570, REGN3504 and any of the PD-L1 antibodies disclosed in WO2017/034916, WO2017/020291, WO2017/020858, WO2017/020801, WO2016/111645, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/195163, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 or WO2007/005874, which antibodies and sequences are incorporated herein by reference.

In one embodiment, the antigen-binding site specifically binds PD-L1, e.g. hPD-L1. In one embodiment, the PD-L1 antigen-binding site comprises the CDRH1, CDRH2, CDRH3, CDRL1, CDRL2 and CDRL3, or the $V_H$, or the $V_L$ or the $V_H$ and $V_L$ region from any one of the anti-PD-L1 antibodies selected from atezolizumab/MPDL3280A (Roche), avelumab/MSB0010718C (Merck), BMS-936559/MDX-1105 (BMS), durvalumab/Medi4736 (Medimmune), KN-035, CA-170, FAZ-053 M7824, ABBV-368, LY-3300054, GNS-1480, YW243.55.570, REGN3504 and any of the PD-L1 antibodies disclosed in WO2017/034916, WO2017/020291, WO2017/020858, WO2017/020801, WO2016/111645, WO2016/050721, WO2016/197367, WO2016/061142, WO2016/149201, WO2016/000619, WO2016/160792, WO2016/022630, WO2016/007235, WO2015/179654, WO2015/173267, WO2015/181342, WO2015/109124, WO2015/195163, WO2015/112805, WO2015/061668, WO2014/159562, WO2014/165082, WO2014/100079, WO2014/055897, WO2013/181634, WO2013/173223, WO2013/079174, WO2012/145493, WO2011/066389, WO2010/077634, WO2010/036959, WO2010/089411 or WO2007/005874, which antibodies and sequences are incorporated herein by reference.

In one embodiment, the another target antigen is CTLA-4. In one embodiment, the another target antigen is TIGIT. In one embodiment, the another target antigen is TIM-3. In one embodiment, the another target antigen is LAG-3. In one embodiment, the another target antigen is GITR. In one embodiment, the another target antigen is VISTA. In one embodiment, the another target antigen is CD137. In one embodiment, the another target antigen is SIRPα. In one embodiment, the another target antigen is CXCL10. In one embodiment, the another target antigen is CD155. In one embodiment, the another target antigen is CD40.

In another embodiment, the multispecific antibody binds another target antigen which is PD-1 and the binding to PD-1 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CTLA4 and the binding to CTLA4 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is TIGIT and the binding to TIGIT is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is TIM-3 and the binding to TIM-3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is LAG3 and the binding to LAG3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is VISTA and the binding to VISTA is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is BTLA and the binding to BTLA is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is hHVEM and the binding to hHVEM is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CSF1R and the binding to CSF1R is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CCR4 and the binding to CCR4 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD39 and the binding to CD39 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD40 and the binding to CD40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD73 and the binding to CD73 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD96 and the binding to CD96 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCR2 and the binding to CXCR2 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCR4 and the binding to CXCR4 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD200 and the binding to CD200 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is GARP and the binding to GARP is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is SIRPα and the binding to SIRPα is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCL9 and the binding to CXCL9 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCL10 and the binding to CXCL10 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCL11 and the binding to CXCL11 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD155 and the binding to CD155 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD137 and the binding to CD137 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is GITR and the binding to GITR is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is OX40 and the binding to OX40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD40 and the binding to CD40 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CXCR3 and the binding to CXCR3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD27 and the binding to CD27 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

In another embodiment, the multispecific antibody binds another target antigen which is CD3 and the binding to CD3 is provided by an antigen-binding domain (for example, a $V_H$, a $V_L$ or a paired $V_H$ and $V_L$) having any of the sequences, including CDR sequences (for example CDRH3 and/or CDRL3) or variable region sequences as described in Aspect 1A hereinbelow.

As an alternative to providing the binding site for the further target antigen as part of the multispecific antibody, the multispecific antibody may instead be used in combination with an additional binding molecule (e.g., antibody) comprising an antigen-binding domain to the further target antigen, including any of the example antigen-binding domains mentioned.

In any of the following embodiments, a particular antigen-binding site specifically binds to a human target. In one embodiment, the antigen-binding site specifically binds an immune checkpoint inhibitor. In one embodiment, the antigen-binding site specifically binds an immune checkpoint inhibitor selected from PD-1, CTLA-4, TIGIT, TIM-3, LAG-3 and VISTA. In one embodiment, the antigen-binding site specifically binds an immune checkpoint inhibitor selected from TIGIT, CTLA-4, TIM-3 and LAG-3.

In one embodiment, the antigen-binding site specifically binds PD-1, e.g. human PD-1. In one embodiment, the PD-1 antigen-binding site comprises the CDRH1, CDRH2, CDRH3, CDRL1, CDRL2 and CDRL3, or the VH, or the VL or the VH and VL region from pembrolizumab (Keytruda®/MK-3475), nivolumab (Opdivo®/BMS-936558/MDX-1106), MEDI-0680/AMP514, PDR001, Lambrolizumab, BMS-936558, REGN2810, BGB-A317, BGB-108, PDR-001, SHR-1210, JS-001, JNJ-63723283, AGEN-2034, PF-06801591, genolimzumab, MGA-012, IBI-308, BCD-100, TSR-042 ANA011, AUNP-12, KD033, MCLA-134, mDX400, muDX400, STI-A1110, AB011, 244C8, 388D4, XCE853, or pidilizumab/CT-011, or from any one of the anti-PD-1 antibodies described in WO2015/112800 & US2015/0203579 (including the antibodies in Tables 1 to 3), U.S. Pat. Nos. 9,394,365, 5,897,862 and 7,488,802, WO2017/087599 (including antibody SSI-361 and SHB-617), WO2017/079112, WO2017/071625 (including deposit C2015132, hybridoma LT004, and antibodies 6F5/6 F5 (Re), 6F5H1 L1 and 6F5 H2L2), WO2017/058859 (including PD1AB-1 to PD1AB-6), WO2017/058115 (including 67D9, c67D9, and hu67D9), WO2017/055547 (including 12819.15384, 12748.15381, 12748.16124, 12865.15377, 12892.15378, 12796.15376, 12777.15382, 12760.15375 and 13112.15380), WO2017/040790 (including AGEN2033w, AGEN2034w, AGEN2046w, AGEN2047w, AGEN2001w and AGEN2002w), WO2017/025051 & WO2017/024515 (including 1.7.3 hAb, 1.49.9 hAb, 1.103.11 hAb, 1.103.11-v2 hAb, 1.139.15 hAb and 1.153.7 hAb), WO2017/025016 & WO2017/024465 (including antibody A to antibody I), WO2017/020858 & WO2017/020291 (including 1.4.1, 1.14.4, 1.20.15 and 1.46.11), WO2017/019896 & WO2015/112900 & US2015/0210769 (including BAP049-hum01 to BAP049-hum16 and BAP049-Clone-A to BAP049-Clone-E), WO2017/019846 (including PD-1 mAb 1 to PD-1 mAb 15), WO2017/016497 (including MHC723, MHC724, MHC725, MHC728, MHC729, m136-M13, m136-M19, m245-M3, m245-M5 and m136-M14), WO2016/201051 (including antibody EH12.2H7, antibody hPD-1 mAb2, antibody hPD-1 mAb7, antibody hPD-1 mAb9, antibody hPD-1 mAb15, or an anti-PD-1 antibody selected from Table 1), WO2016/197497 (including DFPD1-1 to DFPD1-13), WO2016/197367 (including 2.74.15 and 2.74.15.hAb4 to 2.74.15.hAb8), WO2016/196173 (including the antibodies in Table 5, and FIGS. 1-5), WO2016/127179 (including R3A1, R3A2, R4B3, and R3D6), WO2016/077397 (including the antibodies described in Table 1 of Example 9), WO2016/106159 (including the murine antibodies in Table 3 of Example 2 and the humanised antibodies in Tables 7, 8 and 9 of Example 3), WO2016/092419 (including C1, C2, C3, EH12.1, mAb7-G4, mAb15-G4, mAb-AAA, mAb15-AAA), WO2016/068801 (including clone A3 and its variants and the other antibodies described in FIGS. 1 to 4), WO2016/014688 (including 10D1, 4C10, 7D3, 13F1, 15H5, 14A6, 22A5, 6E1, 5A8, 7A4, and 7A4D and the humanised antibodies of Examples 9/10), WO2016/015685 (including 10F8, BA08-1, BA-08-2 and 15H6), WO2015/091911 & WO2015/091910 (including the anti-canine PD-1 antibodies in Examples 2, 3 and 4), WO2015/091914 (including the anti-canine PD-1 antibodies in Table 3), WO2015/085847 (including mAb005, H005-1 to H005-4), WO2015/058573 (including cAB7), WO2015/036394 (including LOPD180), WO2015/035606 (including the antibodies in Table 1 of Example 2, in Tables 14, 15 and 16 of Example 7 and in tables 20, 21 and 22 of Example 11), WO2014/194302 (including GA2, RG163, RG1H10, RG2A7, RG2H10, SH-A4, RG4A6, GA1, GB1, GB6, GH1, A2, C7, H7, SH-A4, SH-A9, RG1H11, and RG66), WO2014/179664 (including 9A2, 101311, 6E9, APE1922, APE1923, APE1924, APE1950, APE1963 and APE2058), WO2014/206107 (including clone 1, 10, 11, 55, 64, 38, 39, 41 and 48), WO2012/135408 (including h409A11, h409A16, and h409A17), WO2012/145493 (including antibodies 1E3, 1E8, 1H3 and h1H3 Var 1 to h1H3 Var 14), WO2011/110621 (including antibody 949 and the modified versions disclosed in FIGS. 1 to 11), WO2011/110604 (including antibody 948 and the modified versions disclosed in FIGS. 3 to 11), WO2010/089411 (including CNCM deposit number 1-4122, 1-4080 or 1-4081), WO2010/036959 (including the antibodies in Table 1 of Example 1), WO2010/029435 & WO2010/029434 (including clones 2, 10 and 19), WO2008/156712 (including hPD-1.08A, hPD-1.09A, h409A11, h409A16 and h409A17 and the antibodies described in Example 2, Table H, Example 4 and table IV), WO2006/121168 (including clones 17D8, 4H1, 5C4, 4A11, 7D3, 5F4, and 2D3), WO2004/004771 or WO2004/056875 (including PD1-17, PD1-28, PD1-33, PD1-35, PD1-F2 and the Abs described in Table 1); the sequences and features of the anti-PD-1 antibodies are incorporated herein by reference.

In one embodiment, the antigen-binding site specifically binds TIGIT, e.g. human TIGIT. In one embodiment, the TIGIT antigen-binding site comprises the CDRH1, CDRH2, CDR3, CDRL1, CDRL2 and CDRL3, or the VH, or the VL or the VH and VL region from RG-6058 (MTIG-7192A) or from any one of the anti-TIGIT antibodies described in WO2017/053748 (including 1A4, 1D3, 4A3, 10A7, 4.1D3.Q1E, h10A7.K4G3, 4.1D3 and the other antibodies described in Examples 1 and 2), WO2017/037707 (including VSIG9 #1 and 258-csl #4), WO2017/030823 (including 14D7, 26610 and humanized versions in Example 3), WO2016/191643 (including 313R11, 313R12, 313R14, 313R19, 313R20, ATCC PTA-122180 and ATCC PTA-122181), WO2016/106302 (including 1462, 13E6, 6F9, 11G11, 10C9, 16F6, 11C9, 27A9, 10D7, 20G6, 24E8, 24G1, 27F1, 15A6, 4E4, 13D1, 91311, 1068, 22G2, 19H2, 8C8, 17G4, 25E7, 26D8 and 16A8), WO2016/028656 (including 14A6, 28H5 or 3106 and humanized versions from Example 6), and WO2009/126688 (US2013/0251720, including 10A7 and 1F4); the sequences and features of the anti-TIGIT antibodies are incorporated herein by reference.

In one embodiment, the antigen-binding site specifically binds TIM-3, e.g. human TIM-3. In one embodiment, the TIM-3 antigen-binding site comprises the CDRH1, CDRH2, CDR3, CDRL1, CDRL2 and CDRL3, or the VH, or the VL or the VH and VL region from F38-2E2 (BioLegend), clone 2E2 (Merck Millipore), clone 6136E2, clone 024 (Sino Biological) clone 344801 (R&D Systems), clone E-18, clone H-191 (Santa Cruz Biotechnology), or clone 13A224 (United States Biological), TSR-022 (Tesaro) or from any one of the anti-TIM-3 antibodies described in WO2017/079115 (including anti-TIM3 antibodies listed in tables 30-38), WO2017/055404 (including PD1TIM3-0389, PD1TIM3-0168, PD1TIM3-0166, TIM3-0038, TIM3-0018, TIM3-0028, TIM3-0438—Table C), WO2017/031242 (Table 10), WO2016/179194 (including antibodies in FIG. 1b, including mAb F38-2E2 and 2E2), WO2016/171722 (including 344823 and antibodies from the hybridomas 7D11, 10G12, 11G8, 8B.2C12 and 25F.1D6), WO2016/161270 (including APE5137 and APE5121), WO2016/111947 (including mAb5, mAb13, mAb15, mAb17, mAb21, mAb22, mAb26, mAb27, mAb48, mAb58 and mAb91), WO2016/071448 (including TIM3-0016, TIM3-0018, TIM3-0021, TIM3-0022, TIM3-0026, TIM3-0028, TIM3-0030, TIM3-0033, TIM3-0038, TIM3-0433, TIM3-0434, TIM3-0438 and TIM3-0443), WO2016/068802 (including 169, 1H9, 1H10, 2C7, 2F4, 2G6, 1D9, 1F4 and 2C8—FIGS. 1, 2 & 3), WO2016/068803 (including A3, 1310, G6, G7, G9, A11 and A11_gl—FIGS. 1, 2 & 3), WO2015/117002 (including ABTIM3, ABTIM3-hum02, ABTIM3-hum05, ABTIM3-hum06, ABTIM3-hum09, ABTIM3-hum10, ABTIM3-hum12, ABTIM-hum01, ABTIM-hum04, ABTIM3-hum07, ABTIM3-hum08, ABTIM3-hum04, ABTIM3-hum21, ABTIM3-hum03, ABTIM3-hum11 and antibodies listed in Table 9), WO2015/048312 (including 5D12), WO2014/022332 (including 2C12), WO2013/006490 (including antibodies in Table 1), WO2011/155607 (including 512, 644, 4545, 4177, 8213, 344823 and 34823), WO2003/063792 (including antibody 8B3.2C12 and 25F.1D6), WO2017/019897 (including antibody molecules disclosed in Tables 1-4, including ABTIM3, ABTIM3-hum20, ABTIM3-hum22 and ABTIM3-hum23), WO2016/079050 & WO2016/079050 (including Tim3_0022, Tim3_0016, Tim3_0018, Tim3_00122, Tim3_0022, Tim3_0021, Tim3_0028, Tim3_0026, Tim3_0033, Tim3_0038, Tim3_0030, 1.7. E10, F38-2EL and 27-12E12); the sequences and features of the anti-TIM-3 antibodies are incorporated herein by reference.

In one embodiment, the antigen-binding site specifically binds LAG-3, e.g. human LAG-3. In one embodiment, the LAG-3 antigen-binding site comprises the CDRH1, CDRH2, CDR3, CDRL1, CDRL2 and CDRL3, or the $V_H$, or the $V_L$ or the $V_H$ and $V_L$ region from antibody clone 1764 (Enzo Life Sciences), or clone 333210 (R&D Systems), or clone 14L676 (United States Biological), or C9B7W (PharMingen), or 11E, or IMO321, or mAb C9B7W (BioXcell) or from any one of the anti-LAG-3 antibodies described in WO95/30750, WO2004/078928, WO2008/132601 (including IMP731 Lag-3 Ab, IMP321, A9H12 Lag-3 mAb and 31G11), WO2010/019570 (including 25F7, 26H10, 25E3, 867, 11F2 and 17E5), WO2014/140180 (including H5L7, H5L7BW, IMP731 and antibodies in Tables 3 & Table 7), WO2014/179664 (including APE03109), WO2014/008218 (including Lag3.1, Lag3.5, Lag3.6, Lag3.7 and Lag3.8), WO2015/042246, WO2015/116539 (including BMS-986016), WO2015/138920 (including BAP050-hum01 to BAP050-hum20, huBAP050(Ser), BAP050-hum01-Ser to BAP050-hum20-Ser, BAP050-Clone-F, BAP050-Clone-G, BAP050-Clone-H, BAP050-Clone-I, BAP050-Clone-J, BAP050 and BAP050-chi), WO2015/198312, WO2016/028672 (including Ab1, Ab2, Ab3, Ab4, Ab5, Ab6, Ab7, Ab8 and Ab9), WO2016/126858, WO2016/200782 (including LAG-3 mAb1 to LAG-3 mAb6), WO2017/015560 (including L32D10, L3E3, L3C5, L35D4, L35G6, L33H11, L32A9, L32A4, L3A1 and the antibodies listed in Table 3), WO2017/062888 (including mAb1, H4H15477P, H4H15483P, H4H15484P, H4H15491, H4H17823P, H4H17826P2, H4H17828P2, H4sH15460P, H4sH15462P, H4sH15463P, H4sH15464P, H4sH15466P, H4sH15467P, H4sH15470P, H4sH15475P, H4sH15479P, H4sH15480P, H4sH15482P, H4sH15488P, H4sH15496P2, H4sH15498P2, H4sH15505P2, H4sH15518P2, H4sH15523P2, H4sH15530P2, H4sH15555P2, H4sH15558P2, H4sH15567P2 and H4H17819P), WO2017/019894, WO2017/037203 (including 8E2, 13E2, 34F4, 1764 and IMP761), WO2017/087589 (including 11609) or WO2017/087901; the sequences and features of the anti-LAG-3 antibodies are incorporated herein by reference.

In one embodiment, the antigen-binding site specifically binds VISTA, e.g. human VISTA. In one embodiment, the VISTA antigen-binding site comprises the CDRH1, CDRH2, CDR3, CDRL1, CDRL2 and CDRL3, or the $V_H$, or the $V_L$ or the $V_H$ and $V_L$ region from any one of the anti-VISTA antibodies described in WO2016/207717 & WO2015/097536 (including VSTB50, VSTB53, VSTB60, VSTB95, VSTB112, VSTB116, VSTB174, VSTB175, VSTB149, VSTB140 and the antibodies in Table 1A and Examples 7 and 8) and WO2014/190356 (including clone 2D3 and 18C3); the sequences and features of the anti-VISTA antibodies are incorporated herein by reference.

In one embodiment, the antigen-binding site specifically binds CTLA-4, e.g. hCTLA-4. In one embodiment, the CTLA-4 antigen-binding site comprises the CDRH1, CDRH2, CDR3, CDRL1, CDRL2 and CDRL3, or the $V_H$, or the $V_L$ or the $V_H$ and $V_L$ region from ipilimumab (MDX-010, CAS No. 477202-00-9), tremelimumab (ticilimumab/CP-675,206), antibody clone 2F1, clone 1F4 (Abnova Corporation), clone 9H10 (EMD Millipore), clone BNU3 (GeneTex), clone 1 E2, clone AS32 (Lifespan Biosciences), clone A3.4H2.H12 (Acris Antibodies), clone 060 (Sino Biological), clone BU5G3 (Creative Diagnostics), clone MIH8 (MBL International), clone A3.6B10.G1, or clone L3D10 (BioLegend) or from any one of the anti-CTLA-4 antibodies described in WO2017/087588 (ISVs disclosed in FIG. 2), WO2017/084078 (clones C2, C4, C10, C11, C12 and C13, and FIGS. 4-7), WO2016/196237 (including AGEN1884w, AGEN2041w, the sequences in FIGS. 19A, 19B and Tables 1-6), WO2016/130986 & WO2016/130898 (including E8, F7 and the Abs described in Table 4), WO2016/015675 (including hybridoma LT001 and antibodies 8D2, 8D2H1L1, 8D2H2L2, 8D2H3L3, 8D2H2L15 and 8D2H2L17), WO2012/120125 (including 3610, 8H5, and the Abs identified in Examples 1, 2, 3 and 5), WO2010/097597 (including JMW-3B3 and the variants and fragments disclosed), WO2009/100140 (including 10D1, 1H5, 3A4, 6C10 and the antibodies described in FIGS. 1 to 6), WO2007/008463 & WO2006/101692 & WO2006/101691 & WO2006/048749 & WO2005/09238, (including 4.1.1, 4.8.1, 4.10.2, 4.13.1, 4.14.3, 6.1.1, 11.2.1, 11.6.1, 11.7.1, 12.3.1.1, 12.9.1.1, and 10D1), WO2006/096491 (including ATCC Deposit No. 11.2.1 11.2.1.4 PTA-5169 and 4.1.1 4.1.1.1 PTA-5166), WO2006/066568 (including TGN2122.C, TGN2422.C, 4.8H10H5 and 4.3F6B5 and the antibodies described in tables 3 to 14), WO2006/029219 (including L3D10, L1611, K4G4, KM10, and YL2), WO2004/029069 (including ATCC deposit number PTA-4537), WO01/54732 (including antibodies 25, 26, 27, 29, 33, 34, 35, 36 and 38), WO01/14424 (including 3A4, 9A5, 2E2, 2E7, 466, 4E10, 5C4, 5G1, 11E8, and 11G1 and the antibodies identified in Examples 3 and 4 and table 3) and WO00/37504 (including 3.1.1, 4.1.1, 4.8.1, 4.10.2, 4.13.1, 4.14.3, 6.1.1, 11.2.1, 11.6.1, 11.7.1, 12.3.1.1, and 12.9.1.1); the sequences and features of the anti-CTLA-4 antibodies are incorporated herein by reference.

In one embodiment, the antigen-binding site specifically binds an immune modulator. In one embodiment, the antigen-binding site specifically binds an immune modulator selected from BTLA, hHVEM, CSF1R, CCR4, CD39, CD40, CD73, CD96, CXCR2, CXCR4, CD200, GARP, SIRPα, CXCL9, CXCL10, CXCL11 and CD155, or from BTLA, hHVEM, CSF1R, CCR4, CD39, CD40, CD73, CD96, CXCR2, CXCR4, CD200, GARP, SIRPα, CXCL9, CXCL10 and CD155. In one embodiment, the antigen-binding site specifically binds an immune modulator selected from GARP, SIRPα, CXCR4, BTLA, hVEM and CSF1R.

In one embodiment, the antigen-binding site specifically binds GARP, e.g. human GARP. In one embodiment, the GARP antigen-binding site comprises the CDRH1, CDRH2, CDR3, CDRL1, CDRL2 and CDRL3, or the $V_H$, or the $V_L$ or the $V_H$ and $V_L$ region from G14D9, Plato-1, 272, G6, G10 or 71311 or from any one of the anti-GARP antibodies described in WO2007/113301 & WO2015/015003 (including MHGARP8, LHG-10, LHG-10-D, LHG-10.3-D, LHG-10.4-D, LHG-10.5-D, LHG-10.6-D, LHG-10.3, LHG-10.4, LHG-10.5, LHG-10.6, 27E10, MHGARP1, MHGARP2, MHGARP3, MHGARP4, MHGARP5, MHGARP6, MHGARP7 and MHGARP9), WO2017/051888 (including 110F, 105F, c151D, c198D, h198D, h151D, h151D-H1L1 and h198D-H3L4); the sequences and features of the anti-GARP antibodies are incorporated herein by reference.

In one embodiment, the antigen-binding site specifically binds SIRPα, e.g. human SIRP□. In one embodiment, the SIRPα antigen-binding site comprises the CDRH1, CDRH2, CDR3, CDRL1, CDRL2 and CDRL3, or the VH, or the VL or the VH and VL region from ED9 (ThermoFisher), or 602411 (Novus Biologicals), or from any one of the anti-SIRPα antibodies described in WO97/48723, WO00/24869 (including 10C4), WO00/66159 (including ED9 and ED17), WO01/40307, WO02/092784 (including SE5A5, SE7C2 and SE12C3), WO2004/108923 (including SE12C3 and 2F34), WO2009/046541 (including P84), WO2011/076781, WO2012/172521, WO2012/040207 (including SE5A5 and mouse P84), WO2013/056352 (including 29-AM4-5, Ab AM4-5, AM5-1, AM5-3, AM5-5, AM5-6, SIRPalpha-AM3-35, AM4-1, SIRP29-AM3-35, SIRP29-AM4-5, SIRP29-AM4-1, 29-AM2-2, 29-AM4-4, 29-AM4-1, 29-AM4-5, 29-AM3-35 and SIRP29-AM3-63), WO2016/063233, WO2016/205042 (including P362) or WO2015/138600 (including KWAR23); the sequences and features of the anti-SIRPα antibodies are incorporated herein by reference.

In one embodiment, the antigen-binding site specifically binds CXCR4, e.g. human CXCR4. In one embodiment, the CXCR4 antigen-binding site comprises the CDRH1, CDRH2, CDR3, CDRL1, CDRL2 and CDRL3, or the $V_H$, or the $V_L$ or the $V_H$ and $V_L$ region of ulocuplumab/BMS-936564, clone 44717.111 or PF-06747143 or from any one of the anti-CXCR4 antibodies described in WO97/49424 (including MAB12G5), WO99/50461, WO01/42308, WO03/066830 & WO2003/066830 (including Ab124 and Ab125), WO2004/059285 (including ALX40-4C), WO2006/089141 (including mAbs 2N, 6R, 18, 19, 20, 33 and 48), WO2007/005605, WO2008/142303 (including MAB170, MAB171, MAB173 and MAB172), WO2008/060367 & WO2013/071068 & WO2015/015401 (including BMS-936564/MDX-1338), WO2009/140124 (including antibody I, II, III, IV and V), WO2009/117706 (including 701, 708, 716, 717, 718 and 4G10), WO2011/161266 (including 4CXCR100, 4CXCR103, 4CXCR104, 4CXCR101, 4CXCR238D2 and 4CXCR238D4), WO2011/098762 (including C-9P21 (Table 1), B-1M22 (Table 2), C1124 (Table 3), D-1K21 (Table 4) and 9N10 (Table 5)), WO2012/175576, WO2013/013025 (including 2A4, 6C7, 4C1, 7C8, 5C9 and 5E1), WO2013/017566 (including Mab 427aB1 and 515H7), WO2013/017562 (including 1-3859 Mab and 515H7), WO2015/069874 (including antibodies corresponding to Seq ID numbers 25 and 29), WO2015/015401 (including 12A11, 6B6, 3G10, m3G10.hIgG1, m3G10.hIgG4, h3G10.A57.hIgG1, h3G10.A57.A58A.hIgG1, h3G10.1.91.A58A.hIgG1, h3G10.1.91.A58B.hIgG1 and h3G10.2.37.2.72.hIgG1), WO2016/156570 (including 281F12, 281A6 and 281D4), WO2016/109872 (including antibodies listed in tables 1, 2, 9 & 12, M3-114-6H, AM4-272-6H, AM3-523-6H, AM4-272, AM3-114, AM3-523, AM4-746 and AM4-1121), WO2017/071625, WO2012/175576, WO2010/125162 & WO2012/055980 & WO2011/121040 & WO2010/037831 (including c414H5 (414H5), c515H7 (515H7) and 301aE5), WO2009/138519 (including ALX40-4C, 238D2, 238D4, 237B5 antibodies and sequences listed in table 1, table 1.1, table A-I, table B-1.1 & B-5), WO2011/042398 (including 238D2 and 238D4), WO2011/083140 (including those disclosed in Tables C-2, C-3, C-4 & C-5, FIG. 2 and ALX-0651, 15H3, 10E12, 10G10, 23866, 10E9, 281E10, 10A10, 14A2 and 15A1) or WO2011/083141); the sequences and features of the anti-CXCR4 antibodies are incorporated herein by reference.

In one embodiment, the antigen-binding site specifically binds BTLA, e.g. hBTLA. In one embodiment, the BTLA antigen-binding site comprises the CDRH1, CDRH2, CDR3, CDRL1, CDRL2 and CDRL3, or the $V_H$, or the $V_L$ or the $V_H$ and $V_L$ region from antibody clone 167, clone 2G8, clone 4C5 (Abnova Corporation), clone 468 (antibodies-online), clone MIH26 (Thermo Scientific Pierce Antibodies), clone UMAB61 (OriGene Technologies), clone 330104 (R&D Systems), clone 1B4 (Lifespan Biosciences), clone 440205, clone 5E7 (Creative Diagnostics) or from any one of the anti-BTLA antibodies described in WO2016/176583 (including clone 6F4), WO2011/014438 (including 8D5, 8A3, 20H4, 21H6, 15C5, 19A7 and 4C7), WO2010/106051 (including CNCM deposit number I-4123) and WO2008/076560 (including 1B4, E4H9, 3C2, 3C2a, 6A5, 11E2, E8D9, 10H6 and 4C9 as detailed in Example 2); the sequences and features of the anti-BTLA antibodies are incorporated herein by reference.

In one embodiment, the antigen-binding site specifically binds hVEM, e.g. human hVEM. In one embodiment, the HVEM antigen-binding site comprises the CDRH1, CDRH2, CDRH3, CDRL1, CDRL2 and CDRL3, or the $V_H$, or the $V_L$ or the $V_H$ and $V_L$ region from any one of the anti-HVEM antibodies described in WO2008/083169 (including LBH1); the sequences and features of the anti-BTLA antibodies are incorporated herein by reference.

In one embodiment, the antigen-binding site specifically binds CSF1R. In one embodiment, the CSF1R antigen-binding site comprises the CDRH1, CDRH2, CDRH3, CDRL1, CDRL2 and CDRL3, or the $V_H$, or the $V_L$ or the $V_H$ and $V_L$ region from any one of the anti-CSF1R antibodies described in WO2009/026303 (including 1.2, 1.109, 2.360 and 1.2.SM and the antibodies in FIGS. 1 and 2), WO2009/112245 (including CXIIG6), WO2011/070024 (including Mab 2F11, 2E10, 2H7 and 1G10, and their derivatives), WO2011/107553 (including 7H5.2G10/DSM ACC2922), WO2011/123381 (including antibody 1 and antibody 2), WO2011/131407 (including 7G5.3B6/DSM ACC2921), WO2011/140249 (including 0301, 0302, and 0311 their derivatives and the antibodies in tables 2, 3 and 5), WO2013/169264 & WO2014/036357 & WO2016/106180 & WO2016/168149 (including huAb1 to huAb16), WO2012/110360 & WO2013/057281 (including CXIIG6, H19K12, H27K5 and H27K15 and the humanised antibodies of tables 1 and 2), WO2013/087699 (including 9D11.2E8 and 10H2.2F12), WO2014/072441 (including H27K15), WO2014/173814 & WO2013/132044 (including Mab 2F11, Mab 2E10, Mab 2H7, Mab 1G10 and sc2-4A5 and the antibodies in Table 3 and 3b), WO2015/028455 & WO2015/028454 (including Ab535, Ab969, and derivatives, e.g. Ab969.g2), WO2015/036511 & WO2016/207312 (including 2F11, 2E10 and the derivatives described in embodiment 33) and WO2017/049038 (including ALM-423 and the antibodies listed in Table 2); the sequences and features of the anti-CSF1R antibodies are incorporated herein by reference.

In one embodiment, the antigen-binding site specifically binds CD39. In one embodiment, the CD39 antigen-binding site comprises the CDRH1, CDRH2, CDR3, CDRL1, CDRL2 and CDRL3, or the $V_H$, or the $V_L$ or the $V_H$ and $V_L$ region from BY40, BY12, BA54g (Biolegend), BU61 (Santa Cruz Biotech), A1 (Ebiosciences), AC2 (Immunotech), 22A9 (Abcam), 24DMS1 or any one of the anti-CD39 antibodies described in WO96/32471, WO00/04041, WO01/10205 (including CD39L4), WO2009/09547 (including CNCM-I-3889/BY40), WO2014/169255, WO2012/085132 (including antibodies VY12, BY40 and BA54g), WO2016/073845 (including R29-5-13A, R29-5-71A, R29-5-165C and R29-9-8B), WO2017/089334 (including 1-391, 1-392 and antibodies produced from hybridomas 1-3889 and CNCM I-41171) and WO2009/095478; the sequences and features of the anti-CD39 antibodies are incorporated herein by reference.

In one embodiment, the antigen-binding site specifically binds CD40, e.g. human CD40. In one embodiment, the CD40 antigen-binding site comprises the CDRH1, CDRH2, CDR3, CDRL1, CDRL2 and CDRL3, or the $V_H$, or the $V_L$ or the $V_H$ and $V_L$ region from BMS3h-56-269, CP-870,893, dacetuzumab, SEA-CD40, ADC-1013, R07009789 and Chi Lob 7/4, or from any one of the anti-CD40 antibodies described in WO2017/059243, WO2017/059196, WO2017/040932, WO2017/040566, WO2017/004016, WO2017/004006, WO2016/196314, WO2016/028810, WO2016/023960, WO2016/023875, WO2015/134988, WO2015/091853, WO2014/070934, WO2014/065403, WO2014/065402, WO2014/04298, WO2013/164789, WO2013/034904, WO2012/149356, WO2012/145673, WO2012/125569, WO2012/111762, WO2012/075111, WO2012/065950, WO2012/041635, WO2011/123489, WO2010/123012, WO2010/104761, WO2010/121231, WO2009/062125, WO2010/104747, WO2010/104748, WO2010/104749, WO2010/024676, WO2009/094391, WO2009/062054, WO2008/091954, WO2007/130493, WO2007/129895, WO2007/124299, WO2007/053767, WO2007/053661, WO2006/128103, WO2006/073443, WO2005/063981, WO2005/063289 (US2012/0263732), WO2005/044855, WO2005/044306, WO2005/044294, WO2005/044307, WO2005/044304, WO2005/044854, WO2005/044305, WO03/040170 (U.S. Pat. Nos. 7,563,442B, 7,618,633B, 7,338,660B, 7,288,251B, 7,626,012B, 8,388,971B, US2013/0024956), WO03/029296, WO02/088186, WO01/83755, WO02/28905, WO02/28480, WO02/28481, WO02/28904, WO01/37870, WO01/16180, WO00/75348 and WO99/42075, WO97/31025, WO95/17202 and WO95/09653; the sequences and features of the anti-CD40 antibodies are incorporated herein by reference.

In one embodiment, the antigen-binding site specifically binds CD73. In one embodiment, the CD73 antigen-binding site comprises the CDRH1, CDRH2, CDR3, CDRL1, CDRL2 and CDRL3, or the VH, or the VL or the VH and VL region from 1E9 (Santa Cruz Biotechnology), AD2, 7G2, 4G4 or from any one of the anti-CD73 antibodies described in WO2017/064043 (including 7H10, 12F9, 15D7, 4611, 11D9 and 9D2), WO2016/081748 (including 4C3, 7A11, 6E11, 5F8, 4C3, 11F11, 11A6, CD73.4-1, CD73.4-2, CD73.3, 11F11-1, 11F11-2, 11F11, 4C3-1, 4C3-2, 4C3-3, 4D4, 10D2-1, 10D2-2, 11A6, 24H2, 5F8-1, 5F8-2 and 5F8-3), WO2016/131950 (including 11E1, 8C7, 3C12 and 6E1), WO2016/075176 (including MEDI9447, clone 10.3 and clone 2C5) & WO2016/075099 (including CD730004, CD730008, CD7300011, CD730021, CD730042, CD730046, CD730047, CD730068 and CD730069), WO2016/055609 (including 11E1, 6E1, 3C12 and 8C7); the sequences and features of the anti-CD73 antibodies are incorporated herein by reference.

In one embodiment, the antigen-binding site specifically binds CD96. In one embodiment, the CD96 antigen-binding site comprises the CDRH1, CDRH2, CDR3, CDRL1, CDRL2 and CDRL3, or the $V_H$, or the $V_L$ or the $V_H$ and $V_L$ region of 6A6, or NK92.39 (E bioscience), 1C8, 3H8, MAA6359 or from any one of the anti-CD96 antibodies described in WO2008/073316, WO2009/007124, WO2013/184912, WO2014/089169, WO2014/149310 (including antibody 3.3), WO2015/024060 or WO2015/024042, WO2015/024060 (including mAb 3.3); the sequences and features of the anti-CD96 antibodies are incorporated herein by reference.

In one embodiment, the antigen-binding site specifically binds CXCR2. In one embodiment, the CXCR2 antigen-binding site comprises the CDRH1, CDRH2, CDR3, CDRL1, CDRL2 and CDRL3, or the $V_H$, or the $V_L$ or the $V_H$ and $V_L$ region from any one of the anti-CXCR2 antibodies described in WO2015/169811 (including HY29 and HY29GL), WO2014/170317 (including CX2-Mab #1 to #19), WO2012/062713, WO2013/168108 (including 163D2-127D1, 163E3-127D1, 163E3-54612, 163D2-54B12, 262-163E3, 262-163D2, 97A9-2B2, 97A9-54B12, 127D1-163D2, 127D1-163E3, 2B2-97A9, 54B612-163D2, 54612-163E3, 163D2-2B2, 163E3-262, 127D1-97A9, 54B12-97A9, 97A9-127D1 and derivatives thereof), WO2009/117706 (including 48311.211, 5E8/CXCR2, clone 19 and derivatives thereof), WO2009/120186 (including RII115, 48311 and derivatives thereof) and WO2002/26249; the sequences and features of the anti-CXCR2 antibodies are incorporated herein by reference.

In one embodiment, the antigen-binding site specifically binds CD200. In one embodiment, the CD200 antigen-binding site comprises the CDRH1, CDRH2, CDR3, CDRL1, CDRL2 and CDRL3, or the $V_H$, or the $V_L$ or the $V_H$ and $V_L$ region DX-109, samalizumab/ALXN-6000, TTI-200.7 or from any one of the anti-CD200 antibodies described in WO99/24565 (including M365 and the antibodies in Examples 4 and 5), WO02/11762 (including 366 and the antibodies in the Examples), WO2004/060295 (US2004/0213783), WO2004/078938 (including scFv-9), WO2006/020266 (U.S. Pat. No. 8,840,885B2, including CG1R3A10, cG2aR3A10, cG2aR3B7, dGIR3A5, dGIR3B5, and dGIR3B10 and the antibodies described in FIGS. 9A-9C, FIGS. 21A and 21B), WO2007/084321 (U.S. Pat. No. 8,709,415B2, including ALXN5200, hB7VH3VL2, C2aB7G1, C2aB7G2/G4, V3V2-G1 and V3V2-G2/G4), WO2009/014745 (including OX90mG2a (FIG. 10), OX90NE and OX90NE-AG), and WO2011/100538 & US2013/0189258 (including Antibody 1 and Antibody 2); the sequences and features of the anti-CD200 antibodies are incorporated herein by reference.

In one embodiment, the antigen-binding site specifically binds CCR4, e.g. human CCR4. In one embodiment, the CCR4 antigen-binding site comprises the CDRH1, CDRH2, CDR3, CDRL1, CDRL2 and CDRL3, or the $V_H$, or the $V_L$ or the $V_H$ and $V_L$ region from mogamulizumab, KM3060 (see Niwa et al., 2004, Cancer Research 64, 2127-2133), and KW-0761 (see Ishida et al., Annals of Oncology 2008, vol 19, supplement 4, 513) or from any one of the anti-CCR4 antibodies described in WO2016/178779 & WO2016/057488 (including mAb2-3, 1-44, 1-49, 2-1 and 2-2), WO2015/179236 (including KW-0761), WO2013/166500 (including mAb1567, c1567, h1567, mAb 1-4 and 2-3 and the antibodies in Examples 6 and 13), WO2012/076883 (including antibodies 208, 306, 308, 406, 501, 503, 601, 603 and 803—Tables 1-9), WO2010/142952 (including 17G, 9E, 11F, 9E10, 9E10J and 9E1 D—see Tables 1-16), WO2009/086514 (including mAb1567 and the humanised mAbs in Example 14), WO2005/035582 (including the DG44/CCR4 antibody and the Ms705/CCR4 antibody (FERM BP-8467)), WO2005/053741 & WO01/64754 (U.S. Pat. Nos. 6,989,145B, 7,666,418B, 8,197,814B, 8,632, 996B, including KM2160 (FERM BP-10090), KM2760 (FERM deposit BP-7054)), WO2003/018635 (including KM2160, KM8759 (FERM BP-8129) and KM8760 (FERM BP-8130), WO00/42074 (U.S. Pat. Nos. 6,488,930B, 7,138, 117B, including 2610, 10E4, 1G1 and the antibodies deposited as ATCC accession number HB-12624 and HB-12625) and WO00/41724 (U.S. Pat. Nos. 6,881,406B, 6,245,332B, including 1G1 and the antibody deposited under ATCC accession number HB-12624); the sequences and features of the anti-CCR4 antibodies are incorporated herein by reference.

In one embodiment, the antigen-binding site specifically binds CXCL9, e.g. human CXCL9. In one embodiment, the CXCL9 antigen-binding site comprises the CDRH1, CDRH2, CDRH3, CDRL1, CDRL2 and CDRL3, or the $V_H$, or the $V_L$ or the $V_H$ and $V_L$ region from mAb 392-100 or AF392 (R&D Systems).

In one embodiment, the antigen-binding site specifically binds CXCL10. In one embodiment, the CXCL10 antigen-binding site comprises the CDRH1, CDRH2, CDR3, CDRL1, CDRL2 and CDRL3, or the $V_H$, or the $V_L$ or the $V_H$ and $V_L$ region of mAb266 (R & D systems) or from any one of the anti-CXCL10 antibodies described in WO017/8708 (including CR.G (IP-10) (IgG1) (PharMingen) ande IP-10 (IgG)(A.Luster), WO02/15932, WO03/006045, WO2004/082714, WO2004/045525, WO2004/045526, WO2004/101511 (including antibodies in table 1 and AIP12, HuAIP12, MuAIP12, AIP13, HuAIP13, MuAIP13, AIP6, AIP8, AIP14, AIP18, AIP21, AIP22, AIP5 and AIP17), WO2005/060457 (including AIP5, AIP6, AIP8, AIP10, AIP12, AIP13, AIP14, AIP17, AIP18, AIP21, AIP22, AIP32 and AIP36), WO2005/011605, WO2005/023201, WO2005/058815 (including 1D4, 1E1, 2G1, 3C4, 6A5, 6A8, 6610, 7C10, 8F6, 10A12 and 10A12S13C4), WO2005/084708, WO2006/039819, WO2006/118085, WO2008/047486, WO2008/044824 (including antibodies #124, #31, #28, #43 and #137), WO2008/106200, WO2009/023566, WO2012/149320 (including MSX-1100 and 6A5), WO2014/003742 (including the antibody of Example 14), WO2013/170735, WO2014/189306, WO2015/063187; the sequences and features of the anti-CXCL10 antibodies are incorporated herein by reference.

In one embodiment, the antigen-binding site specifically binds CD155, e.g. human CD155. In one embodiment, the CD155 antigen-binding site comprises the CDRH1, CDRH2, CDRH3, CDRL1, CDRL2 and CDRL3, or the $V_H$, or the $V_L$ or the $V_H$ and $V_L$ region from clone SKII.4 (BioLegend).

In one embodiment, the antigen-binding site specifically binds an immune activator. In one embodiment, the antigen-binding site specifically binds an immune activator selected from CD137, GITR, OX40, CD40, CXCR3 (e.g. agonistic activity against CXCR3), CD3 and ICOS (e.g. agonistic activity against ICOS). In one embodiment, the antigen-binding site specifically binds an immune activator selected from ICOS, CD137, GITR and OX40.

In one embodiment, the antigen-binding site specifically binds CD137, e.g. hCD137. In one embodiment, the CD137 antigen-binding site comprises the CDRH1, CDRH2, CDRH3, CDRL1, CDRL2 and CDRL3, or the $V_H$, or the $V_L$ or the $V_H$ and $V_L$ region from urelumab, BMS-663513, PF-05082566 (Pfizer), 1D8 and 3E1, 464 (BioLegend 309809), H4-166-M127 (BD Pharmingen 552532), BBK.2 (Thermo Fisher M S621 PABX), 145501 (Leinco Technologies B591), the antibody produced by cell line deposited as ATCC No. HB-11248 (U.S. Pat. No. 6,974,863) or XmAb-5592, or from any one of the anti-CD137 antibodies described in WO2017/04945, WO2016/134358, WO2015/179236, WO2012/177788, WO2012/145183, WO2012/032433, WO2009/135019, WO2005/035584, U.S. Pat. No. 6,974,863, WO2004/055513 and WO2004/010947; the sequences and features of the anti-CD137 antibodies are incorporated herein by reference.

In one embodiment, the antigen-binding site specifically binds GITR, e.g. hGITR. In one embodiment, the GITR antigen-binding site comprises the CDRH1, CDRH2, CDR3, CDRL1, CDRL2 and CDRL3, or the $V_H$, or the $V_L$ or the $V_H$ and $V_L$ region from MK4166, TRX518, TRX385, MA6689 (R & D Systems), YGITR765 (Novus Biologicals) or 1D8 (Novus Biologicals), or from any one of the anti-GITR antibodies described in WO2015/187835 (including 28F3, 3C3-1, 3C3-2, 2G6, 8A6, 9G7-1, 9G7-2, 14E3, 19H8-1, 19H8-2, 19D3, 18E10, and 6G10), WO2015/184099 (including 1042-7, 32-15, 1039-45, 1333-21, 231-1039-45, 231-32-15, Hum231 #1, Hum231 #2, m6C8, pab1964, to pab1973, pab1975 to pab1977, pab1979 to pab1981, pab1983, pab2159, pab2160, pab2161 and the antibodies in tables 1 and 2), WO2015/031667 (including antibodies Ab1 to Ab59 in table 1), WO2015/026684 (including an antibody with a CDR sequence of Seq ID 1-66), WO2013/039954 (including, 2155, 1718, 1649, 1362, 954, 827, 698, 706 and antibodies listed in Tables 1 & 3), WO2011/051726 (including antibodies containing CDRs a-f listed on page 17), WO2011/028683 (including antibodies 36E5, 61F6, 61G6, 3D6, 6H6, 1D8, 17F10, 35D8, 49A1, 9E5, 31 H6 and antibodies from hybridomas PTA-9889, PTA-9890, PTA-9891, PTA-9892, PTA-9893, PTA-10286, PTA-10287, PTA-10288, PTA-10289, PTA-10290, and PTA-10291), WO2009/009116 (including antibody 2F8), WO2007/133822 (including antibodies listed in Table 1), WO2006/105021 (including 6C8, 2F8, HuN6C8-Agly, HuQ6C8-Gly, and HuQ6C8-Agly), WO2006/050172 & WO2004/084942 (including DTA-1), WO03/006058 (including anti-GITR/TNFRSF18 #AF524), WO2016/054638 (including mAb #1-81, #3-167, #5-139, #7-192, #10-116, #11-126, #12-46, #13-169, #14-182, #15-68 and #17-60), WO2016/196792 (including 6G10, 28F3, 19D3, 18E10, 3C3, 2G6, 8A6, 9G7, 14E3 and 19H8), WO2017/087678 (including 28F3, 19D3, 18E10, 3C3-1, 3C3-2, 2G6, 8A6, 9G7-1, 9G7-2, 14E3, 19H8-1, 19H8-2 and 6G10); the sequences and features of the anti-GITR antibodies are incorporated herein by reference.

Figure 25:
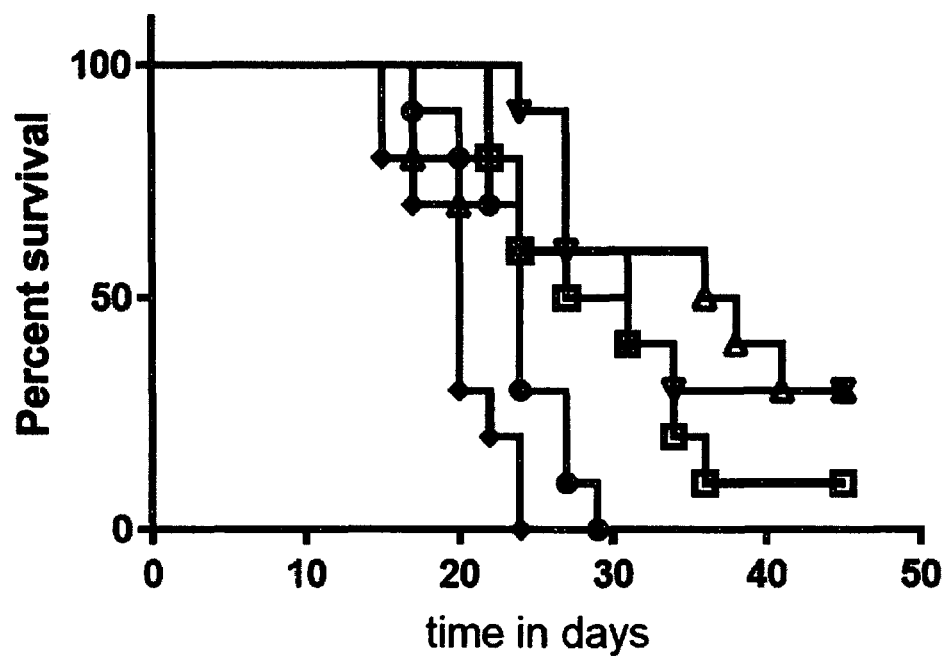
FIG. 25 Kaplan Meier (humane endpoint) showing superior efficacy of treatment with the PD-L1/ICOS bispecific antibodies (down triangles for STIM001_457, up triangles for STIM003_457) compared with combined administration of anti-PD-L1 monospecific antibody and anti-ICOS monospecific antibody (black diamonds) in the EMT6 model described in Example 13. Data from saline control treatments shown in closed circles. Data from IgG1 LAGA hybrid control mAb² antibody with anti-PD-L1 457 Fcab shown in open squares.

In one embodiment, the antigen-binding site specifically binds OX40, e.g. hOX40. In one embodiment, the OX40 antigen-binding site comprises the CDRH1, CDRH2, CDR3, CDRL1, CDRL2 and CDRL3, or the $V_H$, or the $V_L$ or the $V_H$ and $V_L$ region from GSK3174998, L106 BD (Pharmingen Product #340420), ACT35 (Santa Cruz Biotechnology, Catalog #20073), MOXR0916, MEDI-6469, MEDI-0562, 9612 (Weinberg, A. D., et al., J Immunother 29, 575-585 (2006)), the humanised anti-OX40 Ab described in Morris et al., Mol Immunol. May 2007; 44(12): 3112-3121, or from any one of the anti-OX40 antibodies described in WO2017/077085 (including SAP9, SAP28.2, SAP15.3, SAP29-50, SAP25-29 and SAP29-23 and humanised versions described in Examples 4 and 5), WO2017/063162 (including O3, O19, O21 and the affinity matured version in Example 5—Table 2, including 21 #H28H33, 21 #H65, 21 #H96, 21 #VHnew-L80, 21 #H96-L80), WO2017/050729 (including SP197), WO2017/021912 & WO2017/021910 (including ANTIBODY 106-222, OX86, and the antibodies described in FIGS. 6 and 7), WO2016/200836 & WO2016/200835 (including MOXR0916/1A7.gr1 IgG1), WO2016/196228 (including 3F4, 14B6-1, 1466-2, 23H3, 18E9, 8611, 2063, 20C1, 6E1-1, 6E1-2, 14A2, 14A2-1, 14A2-2, L106, OX40.1, OX40.5, OX40.8, OX40.6, and OX40.16 and OX40.21—FIGS. 1 to 10), WO2016/179517 (including 11D4, pab1949, pab1949-1, pab2044, pab2193-1, Tables 1 to 4), WO2016/057667 (including 9612 and OX40mAb24), WO2015/153513 (including 3C8, 1D2, 1A7 and their variants described in the sequence listing, including A1A7.gr1 and 3C8.gr.5, the antibodies described in FIG. 1), WO2014/148895 (including ACT35, 12H3, 12H3 (FIG. 25)—and humanised versions VL1H1, VL1VH2, VL1VH3, VL2H1, VL2VH2 and VL2VH3 (FIGS. 43 & 44) and 20E5 (FIG. 24)), WO2013/068563 (including A26 [FIG. 2]), WO2013/038191 (including ACT35, 12H3 and 12H3), WO2013/028231 (including 119-122, 119-43-1, 106-222 and the antibodies in Table 1), WO2013/008171 (including 2F8, 1D4 and their derivatives, including VH6/VL9, and the antibodies in FIGS. 4 and 5 and tables 6 and 7), WO2012/027328 (including 119-122, 119-43-1, Hu106 and Hu106-222), WO2010/096418 (including A26), WO2008/106116 (including the antibodies in Tables 1 and 2, and A10 (inc A10A-F), B66—FIG. 14—B2, B24, B36, B37, and B39) and WO2007/062245 (including 112V8 (ATCC No. PTA-7219), 112Y55 (ATCC No. PTA-7220), 112Y131 (ATCC No. PTA-7218), 112F32 (ATCC No. PTA-7217) and 112Z5 (ATCC No. PTA-7216); the sequences and features of the anti-OX40 antibodies are incorporated herein by reference.

In one embodiment, the antigen-binding site specifically binds CXCR3, e.g. CXCR3. In one embodiment, the CXCR3 antigen-binding site comprises the CDRH1, CDRH2, CDRH3, CDRL1, CDRL2 and CDRL3, or the $V_H$, or the $V_L$ or the $V_H$ and $V_L$ region from GSK3174998 or from any one of the anti-CXCR3 antibodies described in WO2016/200836, WO2016/200835, WO2016/196228, WO2016/179517, WO2016/057667, WO2015/153513, WO2014/148895, WO2013/068563, WO2013/038191, WO2013/028231, WO2013/008171, WO2012/027328, WO2010/096418, WO2011/073180, WO2008/106116 and WO2007/062245; the sequences and features of the anti-CXCR3 antibodies are incorporated herein by reference.

In one embodiment, the antigen-binding site specifically binds CD27, e.g. hCD27. In one embodiment, the CD27 antigen-binding site comprises the CDRH1, CDRH2, CDRH3, CDRL1, CDRL2 and CDRL3, or the $V_H$, or the $V_L$ or the $V_H$ and $V_L$ region from any one of the anti-CD27 antibodies described in WO2016/145085 (including 1F5), WO2015/016718 (including hCD27.15 and 1F5), WO2014/140374 (including 2F2, 5F24, 5F32, 10F13, 10F31, 11F26, 1052 to 015, F2A4B2 and their derivatives, including hz5F24VH+V5Q, hz5F24VL+K45Q), WO2013/138586 (including C2177, C2186, C2191, and C2192 and the derivatives in Examples 8 to 12, and tables 7 to 42), WO2012/004367 (including hCD27.15/ATCC number PTA-11008), WO2011/130434 (including 1G5, 1H8, 3H12, 3H8, 2G9, 1F5, 3A10, 2C2, ms 1A4, ms 9F4 and ms M-T271), WO2011/081164 & WO2010/001908 (including KM4027, KM4028, KM4026, KM4030, KM4032 and derivatives thereof), WO2008/051424 (including LG3A10 and AT124-1); the sequences and features of the anti-CD27 antibodies are incorporated herein by reference.

In one embodiment, the antigen-binding site specifically binds CD3, e.g. hCD3. In one embodiment, the CD3 antigen-binding site comprises the CDRH1, CDRH2, CDRH3, CDRL1, CDRL2 and CDRL3, or the $V_H$, or the $V_L$ or the $V_H$ and $V_L$ region from OKT3 antibody, otelixizumab, teplizumab or visilizumab, or from any one of the anti-CD3 antibodies described in WO2017/010874, WO2017/009442, WO2016/204966, WO2016/180721, WO2016/179003, WO2016/116626, WO2016/014974, WO2015/104346, WO2015/095392, WO2015/001085, WO2014/047231, WO2013/188693, WO2013/186613, WO2013/158856, WO2012/173819, WO2012/162067, WO2005/118635, WO2004/108158, WO2004/052397, WO2004/024771, WO01/51644, WO00/05268, WO97/44362, WO93/19196, WO92/06193 and WO91/09968; the sequences and features of the anti-CD3 antibodies are incorporated herein by reference.

By providing one molecule having binding sites for (at least) two antigens—ICOS and PD-L1—the present invention facilitates administration of multi-agent therapies to patients. Thus, in situations where it would be impractical and/or unfeasibly expensive to treat a patient with a cocktail of different therapeutic agents, a patient may instead by treated using the multispecific antibody, optionally in combination with one or more other therapies, thereby reducing the number of different drug compositions that are administered to the patient. As noted, the other therapy may comprise administration of an antibody to another target antigen, such as those antigens and antibodies listed above.

The term "in combination" in the context of the administration of other therapies refers to the use of more than one therapy. The use of the term "in combination" does not restrict the order in which therapies are administered to a subject with a disease. A first therapy can be administered before (e.g., 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks), concurrently, or after (e.g., 1 minute, 45 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks) the administration of a second therapy to a subject. Any additional therapy can be administered in any order with the other additional therapies. In certain embodiments, the antibodies of the invention can be administered in combination with one or more therapies (e.g., therapies that are not the antibodies of the invention that are currently administered to prevent, treat, manage, and/or ameliorate a disease. Non-limiting examples of therapies that can be administered in combination with an antibody of the invention include analgesic agents, anaesthetic agents, antibiotics, or immunomodulatory agents or any other agent listed in the U.S. Pharmacopoeia and/or Physician's Desk Reference.

Treatment with an immunomodulatory antibody such as anti-CTLA4, anti-PD1 or anti-PDL1, especially one with Fc effector function (e.g., a human IgG1), may create an environment in which further depletion of ICOS highly expressing immune-suppressive cells is beneficial. It may be advantageous to combine the multispecific antibody of the invention with such an immunomodulator to enhance its therapeutic effects.

A patient who has been treated with an immunomodulatory antibody (e.g., anti-PDL-1, anti-PD-1, anti-CTLA-4) may particularly benefit from treatment with the multispecific antibody. One reason for this is that an immunomodulatory antibody may increase the number of ICOS-positive Tregs (e.g., intratumoural Tregs) in the patient. This effect is also observed with certain other therapeutic agents, such as recombinant IL-2. Anti-ICOS treatment may reduce and/or reverse a surge or rise in ICOS+ Tregs (e.g., intratumoural Tregs) resulting from treatment of the patient with another therapeutic agent. A patient selected for treatment with the multispecific antibody may thus be one who has already received treatment with a first therapeutic agent, the first therapeutic agent being an antibody (e.g., immunomodulator antibody) or other agent (e.g., IL-2) that increases the number of ICOS+ Tregs in the patient.

The multispecific antibody may be used in combination with an antagonist of PD-1 or an antibody (e.g., antagonist antibody) to PD-1. The anti-PD-1 antibody may be any disclosed herein, e.g., pembrolizumab or nivolumab. The anti-PD-1 antibody may be one that inhibits binding of PD-1 to PD-L1 and/or PD-L1.

The multispecific antibody may be used in combination with an antagonist of CTLA-4 or an antibody (e.g., antagonist antibody) to CTLA-4. The anti-CTLA-4 antibody may be any disclosed herein, e.g., ipilimumab or tremelimumab. The anti-CTLA-4 antibody may be one that inhibits binding of CTLA-4 to CD80 and/or CD86.

Antibodies to PD-L1

The antigen-binding site of any anti-PD-L1 antibody may be used in a multispecific antibody. A multispecific antibody may be used in combination with an anti-PD-L1 antibody, or used to treat a patient who has previously received treatment with an anti-PD-L1 antibody. Numerous examples of anti-PD-L1 antibodies are disclosed herein and others are known in the art. Characterisation data for many of the anti-PD-L1 antibodies mentioned here has been published in U.S. Pat. Nos. 9,567,399 and 9,617,338, both incorporated by reference herein.

1D05 has a heavy chain variable region ($V_H$) amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No: 526, Seq ID No:528, Seq ID No: 530, Seq ID No: 532 or Seq ID No: 534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

84G09 has a heavy chain variable ($V_H$) region amino acid sequence of Seq ID No:13, comprising the CDRH1 amino acid sequence of Seq ID No:7 (IMGT) or Seq ID No:10 (Kabat), the CDRH2 amino acid sequence of Seq ID No:8 (IMGT) or Seq ID No:11 (Kabat), and the CDRH3 amino acid sequence of Seq ID No:9 (IMGT) or Seq ID No:12 (Kabat). The heavy chain nucleic acid sequence of the $V_H$ domain is Seq ID No:14. 84G09 has a light chain variable region ($V_L$) amino acid sequence of Seq ID No:23, comprising the CDRL1 amino acid sequence of Seq ID No:17 (IMGT) or Seq ID No:20 (Kabat), the CDRL2 amino acid sequence of Seq ID No:18 (IMGT) or Seq ID No:21 (Kabat), and the CDRL3 amino acid sequence of Seq ID No:19 (IMGT) or Seq ID No:22 (Kabat). The light chain nucleic acid sequence of the $V_L$ domain is Seq ID No:24. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:15 (heavy chain nucleic acid sequence Seq ID No:16). A full length light chain amino acid sequence is Seq ID No:25 (light chain nucleic acid sequence Seq ID No:26).

1D05 HC mutant 1 has a heavy chain variable ($V_H$) region amino acid sequence of Seq ID No:47, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 1 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 2 has a heavy chain variable ($V_H$) region amino acid sequence of Seq ID No:48, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 2 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 3 has a heavy chain variable ($V_H$) region amino acid sequence of Seq ID No:49, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 3 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 HC mutant 4 has a heavy chain variable ($V_H$) region amino acid sequence of Seq ID No:342, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). 1D05 HC mutant 4 has a light chain variable region ($V_L$) amino acid sequence of Seq ID No:43, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length light chain amino acid sequence is Seq ID No:45 (light chain nucleic acid sequence Seq ID No:46).

1D05 LC mutant 1 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 1 has a light chain variable region ($V_L$) amino acid sequence of Seq ID No:50, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1 D05 LC Mutant 1 is as defined by the Kabat or IMGT systems from the $V_L$ sequence of Seq ID No:50. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205 or Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 2 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 2 has a light chain variable region ($V_L$) amino acid sequence of Seq ID No:51, comprising the CDRL1 amino acid sequence of Seq ID No:37 (IMGT) or Seq ID No:40 (Kabat), the CDRL2 amino acid sequence of Seq ID No:38 (IMGT) or Seq ID No:41 (Kabat), and the CDRL3 amino acid sequence of Seq ID No:39 (IMGT) or Seq ID No:42 (Kabat). The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36).

1D05 LC mutant 3 has a heavy chain variable ($V_H$) region amino acid sequence of Seq ID No:33, comprising the CDRH1 amino acid sequence of Seq ID No:27 (IMGT) or Seq ID No:30 (Kabat), the CDRH2 amino acid sequence of Seq ID No:28 (IMGT) or Seq ID No:31 (Kabat), and the CDRH3 amino acid sequence of Seq ID No:29 (IMGT) or Seq ID No:32 (Kabat). The heavy chain nucleic acid sequence of the $V_H$ domain is Seq ID No:34. 1D05 LC mutant 3 has a light chain variable region ($V_L$) amino acid sequence of Seq ID No:298, comprising the CDRL1 amino acid sequence of Seq ID No:37 (IMGT) or Seq ID No:40 (Kabat), and the CDRL3 amino acid sequence of Seq ID No:39 (IMGT) or Seq ID No:42 (Kabat). The CDRL2 sequence of 1 D05 LC Mutant 3 is as defined by the Kabat or IMGT systems from the $V_L$ sequence of Seq ID No:298. The light chain nucleic acid sequence of the $V_L$ domain is Seq ID No:44. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205 or Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:35 (heavy chain nucleic acid sequence Seq ID No:36). A full length light chain amino acid sequence is Seq ID No:45 (light chain nucleic acid sequence Seq ID No:46).

411B08 has a heavy chain variable ($V_H$) region amino acid sequence of Seq ID No:58, comprising the CDRH1 amino acid sequence of Seq ID No:52 (IMGT) or Seq ID No:55 (Kabat), the CDRH2 amino acid sequence of Seq ID No:53 (IMGT) or Seq ID No:56 (Kabat), and the CDRH3 amino acid sequence of Seq ID No:54 (IMGT) or Seq ID No:57 (Kabat). The heavy chain nucleic acid sequence of the $V_H$ domain is Seq ID No:59. 411B08 has a light chain variable region ($V_L$) amino acid sequence of Seq ID No:68, comprising the CDRL1 amino acid sequence of Seq ID No:62 (IMGT) or Seq ID No:65 (Kabat), the CDRL2 amino acid sequence of Seq ID No:63 (IMGT) or Seq ID No:66 (Kabat), and the CDRL3 amino acid sequence of Seq ID No:64 (IMGT) or Seq ID No:67 (Kabat). The light chain nucleic acid sequence of the $V_L$ domain is Seq ID No:69. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:60 (heavy chain nucleic acid sequence Seq ID No:61). A full length light chain amino acid sequence is Seq ID No:70 (light chain nucleic acid sequence Seq ID No:71).

411C04 has a heavy chain variable ($V_H$) region amino acid sequence of Seq ID No:78, comprising the CDRH1 amino acid sequence of Seq ID No:72 (IMGT) or Seq ID No:75 (Kabat), the CDRH2 amino acid sequence of Seq ID No:73 (IMGT) or Seq ID No:76 (Kabat), and the CDRH3 amino acid sequence of Seq ID No:74 (IMGT) or Seq ID No:77 (Kabat). The heavy chain nucleic acid sequence of the $V_H$ domain is Seq ID No:79. 411C04 has a light chain variable region ($V_L$) amino acid sequence of Seq ID No:88, comprising the CDRL1 amino acid sequence of Seq ID No:82 (IMGT) or Seq ID No:85 (Kabat), the CDRL2 amino acid sequence of Seq ID No:83 (IMGT) or Seq ID No:86 (Kabat), and the CDRL3 amino acid sequence of Seq ID No:84 (IMGT) or Seq ID No:87 (Kabat). The light chain nucleic acid sequence of the $V_L$ domain is Seq ID No:89. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:80 (heavy chain nucleic acid sequence Seq ID No:81). A full length light chain amino acid sequence is Seq ID No:90 (light chain nucleic acid sequence Seq ID No:91).

411D07 has a heavy chain variable ($V_H$) region amino acid sequence of Seq ID No:98, comprising the CDRH1 amino acid sequence of Seq ID No:92 (IMGT) or Seq ID No:95 (Kabat), the CDRH2 amino acid sequence of Seq ID No:93 (IMGT) or Seq ID No:96 (Kabat), and the CDRH3 amino acid sequence of Seq ID No:94 (IMGT) or Seq ID No:97 (Kabat). The heavy chain nucleic acid sequence of the $V_H$ domain is Seq ID No:99. 411 D07 has a light chain variable region ($V_L$) amino acid sequence of Seq ID No:108, comprising the CDRL1 amino acid sequence of Seq ID No:102 (IMGT) or Seq ID No:105 (Kabat), the CDRL2 amino acid sequence of Seq ID No:103 (IMGT) or Seq ID No:106 (Kabat), and the CDRL3 amino acid sequence of Seq ID No:104 (IMGT) or Seq ID No:107 (Kabat). The light chain nucleic acid sequence of the $V_L$ domain is Seq ID No:109. The $V_H$ domain may be combined with any of the heavy chain constant region sequences described herein, e.g.

Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:100 (heavy chain nucleic acid sequence Seq ID No:101). A full length light chain amino acid sequence is Seq ID No: 110 (light chain nucleic acid sequence Seq ID No:111).

385F01 has a heavy chain variable (VH) region amino acid sequence of Seq ID No:118, comprising the CDRH1 amino acid sequence of Seq ID No:112 (IMGT) or Seq ID No:115 (Kabat), the CDRH2 amino acid sequence of Seq ID No:113 (IMGT) or Seq ID No:116 (Kabat), and the CDRH3 amino acid sequence of Seq ID No:114 (IMGT) or Seq ID No:117 (Kabat). The heavy chain nucleic acid sequence of the $V_H$ domain is Seq ID No:119. 385F01 has a light chain variable region ($V_L$) amino acid sequence of Seq ID No:128, comprising the CDRL1 amino acid sequence of Seq ID No:122 (IMGT) or Seq ID No:125 (Kabat), the CDRL2 amino acid sequence of Seq ID No:123 (IMGT) or Seq ID No:126 (Kabat), and the CDRL3 amino acid sequence of Seq ID No:124 (IMGT) or Seq ID No:127 (Kabat). The light chain nucleic acid sequence of the $V_L$ domain is Seq ID No:129. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:120 (heavy chain nucleic acid sequence Seq ID No:121). A full length light chain amino acid sequence is Seq ID No:130 (light chain nucleic acid sequence Seq ID No:131). 386H03 has a heavy chain variable ($V_H$) region amino acid sequence of Seq ID No:158, comprising the CDRH1 amino acid sequence of Seq ID No:152 (IMGT) or Seq ID No:155 (Kabat), the CDRH2 amino acid sequence of Seq ID No:153 (IMGT) or Seq ID No:156 (Kabat), and the CDRH3 amino acid sequence of Seq ID No:154 (IMGT) or Seq ID No:157 (Kabat). The heavy chain nucleic acid sequence of the $V_H$ domain is Seq ID No:159.

386H03 has a light chain variable region ($V_L$) amino acid sequence of Seq ID No:168, comprising the CDRL1 amino acid sequence of Seq ID No:162 (IMGT) or Seq ID No:165 (Kabat), the CDRL2 amino acid sequence of Seq ID No:163 (IMGT) or Seq ID No:166 (Kabat), and the CDRL3 amino acid sequence of Seq ID No:164 (IMGT) or Seq ID No:167 (Kabat). The light chain nucleic acid sequence of the $V_L$ domain is Seq ID No:169. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:160 (heavy chain nucleic acid sequence Seq ID No:161). A full length light chain amino acid sequence is Seq ID No:170 (light chain nucleic acid sequence Seq ID No:171).

389A03 has a heavy chain variable ($V_H$) region amino acid sequence of Seq ID No:178, comprising the CDRH1 amino acid sequence of Seq ID No:172 (IMGT) or Seq ID No:175 (Kabat), the CDRH2 amino acid sequence of Seq ID No:173 (IMGT) or Seq ID No:176 (Kabat), and the CDRH3 amino acid sequence of Seq ID No:174 (IMGT) or Seq ID No:177 (Kabat). The heavy chain nucleic acid sequence of the $V_H$ domain is Seq ID No:179. 389A03 has a light chain variable region ($V_L$) amino acid sequence of Seq ID No:188, comprising the CDRL1 amino acid sequence of Seq ID No:182 (IMGT) or Seq ID No:185 (Kabat), the CDRL2 amino acid sequence of Seq ID No:183 (IMGT) or Seq ID No:186 (Kabat), and the CDRL3 amino acid sequence of Seq ID No:184 (IMGT) or Seq ID No:187 (Kabat). The light chain nucleic acid sequence of the $V_L$ domain is Seq ID No:189. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:180 (heavy chain nucleic acid sequence Seq ID No:181). A full length light chain amino acid sequence is Seq ID No:190 (light chain nucleic acid sequence Seq ID No:191).

413D08 has a heavy chain variable ($V_H$) region amino acid sequence of Seq ID No:138, comprising the CDRH1 amino acid sequence of Seq ID No:132 (IMGT) or Seq ID No:135 (Kabat), the CDRH2 amino acid sequence of Seq ID No:133 (IMGT) or Seq ID No:136 (Kabat), and the CDRH3 amino acid sequence of Seq ID No:134 (IMGT) or Seq ID No:137 (Kabat). The heavy chain nucleic acid sequence of the $V_H$ domain is Seq ID No:139. 413D08 has a light chain variable region ($V_L$) amino acid sequence of Seq ID No:148, comprising the CDRL1 amino acid sequence of Seq ID No:142 (IMGT) or Seq ID No:145 (Kabat), the CDRL2 amino acid sequence of Seq ID No:143 (IMGT) or Seq ID No:146 (Kabat), and the CDRL3 amino acid sequence of Seq ID No:144 (IMGT) or Seq ID No:147 (Kabat). The light chain nucleic acid sequence of the $V_L$ domain is Seq ID No:149. The VH domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No: 140 (heavy chain nucleic acid sequence Seq ID No:141). A full length light chain amino acid sequence is Seq ID No:150 (light chain nucleic acid sequence Seq ID No:151).

413G05 has a heavy chain variable ($V_H$) region amino acid sequence of Seq ID No:244, comprising the CDRH1 amino acid sequence of Seq ID No:238 (IMGT) or Seq ID No:241 (Kabat), the CDRH2 amino acid sequence of Seq ID No:239 (IMGT) or Seq ID No:242 (Kabat), and the CDRH3 amino acid sequence of Seq ID No:240 (IMGT) or Seq ID No:243 (Kabat). The heavy chain nucleic acid sequence of the $V_H$ domain is Seq ID No:245. 413G05 has a light chain variable region ($V_L$) amino acid sequence of Seq ID No:254, comprising the CDRL1 amino acid sequence of Seq ID No:248 (IMGT) or Seq ID No:251 (Kabat), the CDRL2 amino acid sequence of Seq ID No:249 (IMGT) or Seq ID No:252 (Kabat), and the CDRL3 amino acid sequence of Seq ID No:250 (IMGT) or Seq ID No:253 (Kabat). The light chain nucleic acid sequence of the $V_L$ domain is Seq ID No:255. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:246 (heavy chain nucleic acid sequence Seq ID No:247). A full length light chain amino acid sequence is Seq ID No:256 (light chain nucleic acid sequence Seq ID No:257).

413F09 has a heavy chain variable ($V_H$) region amino acid sequence of Seq ID No:264, comprising the CDRH1 amino acid sequence of Seq ID No:258 (IMGT) or Seq ID No:261 (Kabat), the CDRH2 amino acid sequence of Seq ID No:259 (IMGT) or Seq ID No:262 (Kabat), and the CDRH3 amino acid sequence of Seq ID No:260 (IMGT) or Seq ID No:263 (Kabat). The heavy chain nucleic acid sequence of the $V_H$ domain is Seq ID No:265. 413F09 has a light chain variable region ($V_L$) amino acid sequence of Seq ID No:274, comprising the CDRL1 amino acid sequence of Seq ID No:268 (IMGT) or Seq ID No:271 (Kabat), the CDRL2 amino acid sequence of Seq ID No:269 (IMGT) or Seq ID No:272 (Kabat), and the CDRL3 amino acid sequence of Seq ID No:270 (IMGT) or Seq ID No:273 (Kabat). The light chain nucleic acid sequence of the $V_L$ domain is Seq ID No:275. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:266 (heavy chain nucleic acid sequence Seq ID No:267). A full length light chain amino acid sequence is Seq ID No:276 (light chain nucleic acid sequence Seq ID No:277).

414B06 has a heavy chain variable ($V_H$) region amino acid sequence of Seq ID No:284, comprising the CDRH1 amino acid sequence of Seq ID No:278 (IMGT) or Seq ID No:281 (Kabat), the CDRH2 amino acid sequence of Seq ID No:279 (IMGT) or Seq ID No:282 (Kabat), and the CDRH3 amino acid sequence of Seq ID No:280 (IMGT) or Seq ID No:283 (Kabat). The heavy chain nucleic acid sequence of the $V_H$ domain is Seq ID No:285. 414B06 has a light chain variable region ($V_L$) amino acid sequence of Seq ID No:294, comprising the CDRL1 amino acid sequence of Seq ID No:288 (IMGT) or Seq ID No:291 (Kabat), the CDRL2 amino acid sequence of Seq ID No:289 (IMGT) or Seq ID No:292 (Kabat), and the CDRL3 amino acid sequence of Seq ID No:290 (IMGT) or Seq ID No:293 (Kabat). The light chain nucleic acid sequence of the $V_L$ domain is Seq ID No:295. The $V_H$ domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The $V_L$ domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:286 (heavy chain nucleic acid sequence Seq ID No:287). A full length light chain amino acid sequence is Seq ID No:296 (light chain nucleic acid sequence Seq ID No:297).

416E01 has a heavy chain variable region ($V_H$) amino acid sequence of Seq ID No:349, comprising the CDRH1 amino acid sequence of Seq ID No:343 (IMGT) or Seq ID No:346 (Kabat), the CDRH2 amino acid sequence of Seq ID No:344 (IMGT) or Seq ID No:347 (Kabat), and the CDRH3 amino acid sequence of Seq ID No:345 (IMGT) or Seq ID No:348 (Kabat). The heavy chain nucleic acid sequence of the $V_H$ domain is Seq ID No:350. 416E01 has a light chain variable region ($V_L$) amino acid sequence of Seq ID No:359, comprising the CDRL1 amino acid sequence of Seq ID No:353 (IMGT) or Seq ID No:356 (Kabat), the CDRL2 amino acid sequence of Seq ID No:354 (IMGT) or Seq ID No:357 (Kabat), and the CDRL3 amino acid sequence of Seq ID No:355 (IMGT) or Seq ID No:358 (Kabat). The light chain nucleic acid sequence of the VL domain is Seq ID No:360. The VH domain may be combined with any of the heavy chain constant region sequences described herein, e.g. Seq ID No:193, Seq ID No:195, Seq ID No:197, Seq ID No:199, Seq ID No:201, Seq ID No:203, Seq ID No:205, Seq ID No:340, Seq ID No:524, Seq ID No:526, Seq ID No:528, Seq ID No:530, Seq ID No:532 or Seq ID No:534. The VL domain may be combined with any of the light chain constant region sequences described herein, e.g. Seq ID Nos:207, 209, 211, 213, 215, 217, 219, 221, 223, 225, 227, 229, 231, 233, 235, 237, 536 and 538. A full length heavy chain amino acid sequence is Seq ID No:351 (heavy chain nucleic acid sequence Seq ID No:352). A full length light chain amino acid sequence is Seq ID No:361 (light chain nucleic acid sequence Seq ID No:362).

Treatment of Diseases and Conditions

Antibodies according to the present invention may be used in methods of treatment of the human body by therapy. The treatment may be treatment of cancer or a number of other conditions exemplified herein.

The antibodies find use in increasing effector T cell response, which is of benefit for a range of diseases or conditions, including treating cancers or solid tumours and in the context of vaccination. Increased Teff response may be achieved using an antibody that modulates the balance or ratio between Teffs and Tregs in favour of Teff activity.

The antibodies may be used for depleting regulatory T cells and/or increasing effector T cell response in a patient, and may be administered to a patient to treat a disease or condition amenable to therapy by depleting regulatory T cells and/or increasing effector T cell response.

An antibody of the present invention, or a composition comprising such an antibody molecule or its encoding nucleic acid, may be used or provided for use in any such method. Use of the antibody, or of a composition comprising it or its encoding nucleic acid, for the manufacture of a medicament for use in any such method is also envisaged. The method typically comprises administering the antibody or composition to a mammal. Suitable formulations and methods of administration are described elsewhere herein.

One envisaged therapeutic use of the antibodies is treatment of cancer. The cancer may be a solid tumour, e.g., renal cell cancer (optionally renal cell carcinoma, e.g., clear cell renal cell carcinoma), head and neck cancer, melanoma (optionally malignant melanoma), non-small cell lung cancer (e.g., adenocarcinoma), bladder cancer, ovarian cancer, cervical cancer, gastric cancer, liver cancer, pancreatic cancer, breast cancer, testicular germ cell carcinoma, or the metastases of a solid tumour such as those listed, or it may be a liquid haematological tumour e.g., lymphoma (such as Hodgkin's lymphoma or Non-Hodgkin's lymphoma, e.g., diffuse large B-cell lymphoma, DLBCL) or leukaemia (e.g., acute myeloid leukaemia). An anti-ICOS antibody may enhance tumour clearance in melanoma, head and neck cancer and non-small cell lung cancer and other cancers with a moderate to high mutational load [32]. By enhancing patients' immune response to their neoplastic lesions, immunotherapy using an anti-ICOS antibody offers the prospect of durable cures or long-term remissions, potentially even in the context of late stage disease.

Cancers are a diverse group of diseases, but anti-ICOS antibodies offer the possibility of treating a range of different cancers by exploiting the patient's own immune system, which has the potential to kill any cancer cell through recognition of mutant or overexpressed epitopes that distinguish cancer cells from normal tissue. By modulating the Teff/Treg balance, anti-ICOS antibodies can enable and/or promote immune recognition and killing of cancer cells. While anti-ICOS antibodies are therefore useful therapeutic agents for a wide variety of cancers, there are particular categories of cancers for which anti-ICOS therapy is especially suited and/or where anti-ICOS therapy can be effective when other therapeutic agents are not.

One such group is cancer that is positive for expression of ICOS ligand. Cancer cells may acquire expression of ICOS ligand, as has been described for melanoma [33]. Expression of ICOS ligand may provide the cells with a selective advantage as the surface-expressed ligand binds ICOS on Tregs, promoting the expansion and activation of the Tregs and thereby suppressing the immune response against the cancer. Cancer cells expressing ICOS ligand may depend for their survival on this suppression of the immune system by Tregs, and would thus be vulnerable to treatment with anti-ICOS antibodies that target the Tregs. This applies also to cancers derived from cells that naturally express ICOS ligand. Continued expression of ICOS ligand by these cells again provides a survival advantage through immune suppression. A cancer expressing ICOS ligand may be derived from antigen-presenting cells such as B cells, dendritic cells and monocytes and may be a liquid haematological tumour such as those mentioned herein. Interestingly it has been shown that these types of cancer are also high in ICOS and FOXP3 expression (TCGA data).

Accordingly, the multispecific antibodies can be used in methods of treating cancers that are positive for expression of ICOS ligand. Further, a cancer to be treated with anti-ICOS antibody according to the present invention may be one that is positive for expression of ICOS and/or FOXP3, and optionally also expresses ICOS ligand.

Patients may undergo testing to determine whether their cancer is positive for expression of the protein of interest (e.g., ICOS ligand, ICOS and/or FOXP3), for example by taking a test sample (e.g., tumour biopsy) from the patient and determining expression of the protein of interest. Patients whose cancer has been characterised as positive for expression of one, two or all such proteins of interest are selected for treatment with anti-ICOS antibody. As discussed elsewhere herein, anti-ICOS antibody may be used as a monotherapy or in combination with one or more other therapeutic agents.

Anti-ICOS antibodies also offer hope to patients whose cancers are refractory to treatment with antibodies or other drugs directed to immune checkpoint molecules such as CTLA-4, PD-1, PD-L1, CD137, GITR or CD73. These immunotherapies are effective against some cancers but in some cases a cancer may not respond, or it may become unresponsive to continued treatment with the antibody. In common with antibodies to immune checkpoint inhibitors, anti-ICOS antibodies modulate the patient's immune system—nevertheless an anti-ICOS antibody may succeed where such other antibodies fail. It is shown herein that animals carrying A20 B cell lymphomas could be treated with anti-ICOS antibodies to reduce growth of the tumour, shrink the tumour and indeed clear the tumour from the body, whereas treatment with an anti-PD-L1 antibody was no better than control. The A20 cell line has also been reported to be resistant to anti-CTLA-4 [34].

Accordingly, the antibodies of the present invention can be used in methods of treating cancers that are refractory to treatment with one or more immunotherapies, such as (any or all of) an anti-CTLA-4 antibody, anti-PD1 antibody, anti-PD-L1 antibody, anti-CD137 antibody, anti-GITR antibody, or anti-CD73 antibody. A cancer may be characterised as being refractory to treatment with an antibody or other drug if treatment with that antibody or drug does not significantly reduce growth of the cancer, e.g., if a tumour continues to grow or does not reduce in size or if after a response period the tumour re-initiates its growth. Non-response to a therapeutic agent may be determined ex vivo by testing a sample (e.g., tumour biopsy sample) for cancer cell killing or growth inhibition, and/or in the clinical setting by observing (e.g., using an imaging technology, including MRI) that a patient treated with the therapy is not responding to treatment. Patients whose cancer has been characterised as refractory to treatment with such an immunotherapy are selected for treatment with anti-ICOS antibody.

Further, the antibodies may be used to treat B-cell derived cancer that is resistant to treatment with an anti-CD20 antibody. Anti-ICOS antibodies represent a treatment for cancers that fail to respond to, or become resistant to, therapy with anti-CD20 antibodies like rituximab. Anti-ICOS antibody may be used as a second-line (or further, or additional) treatment for such cancers. The anti-CD20 antibody resistant cancer may be a B cell cancer, e.g., B cell lymphoma, such as diffuse large B cell lymphoma. Resistance of a cancer to anti-CD20 may be determined ex vivo by testing a sample (e.g., tumour biopsy sample) for cancer cell killing or growth inhibition by anti-CD20 antibody, and/or in the clinical setting by observing that a patient treated with the anti-CD20 antibody is not responding to treatment. Alternatively, or additionally, the cancer (e.g., a tumour biopsy sample) may be tested to assess expression of CD20, where an absence or low level of CD20 expression indicates loss of sensitivity to anti-CD20 antibody.

Samples obtained from patients may thus be tested to determine surface expression of a protein of interest, for example ICOS ligand, ICOS, FOXP3 and/or a target receptor to which another therapeutic agent (e.g., anti-receptor antibody) is directed. The target receptor may be CD20 (to which anti-CD20 antibody therapy such as rituximab is directed), or another receptor such as PD1, EGFR, HER2 or HER3. Surface expression of ICOS ligand, ICOS, FOXP3 and/or lack or loss of surface expression of the target receptor is an indication that the cancer is susceptible to anti-ICOS antibody therapy. Anti-ICOS antibodies can be provided for administration to a patient whose cancer is characterised by surface expression of ICOS ligand, ICOS, FOXP3 and/or lack or loss of surface expression of a target receptor, optionally where the patient has been previously treated with anti-CTLA4, anti-PD1, anti-PD-L1 or with an antibody to the target receptor and has not responded or has stopped responding to treatment with that antibody, as measured for example by continued or renewed cancer cell growth, e.g., increase in tumour size.

Any suitable method may be employed to determine whether cancer cells test positive for surface expression of a protein such as ICOS ligand, CD20 or other target receptors mentioned herein. A typical method is immunohistochemistry, where a sample of the cells (e.g., a tumour biopsy sample) is contacted with an antibody for the protein of interest, and binding of antibody is detected using a labelled reagent—typically a second antibody that recognises the Fc region of the first antibody and carries a detectable label such as a fluorescent marker. A sample may be declared to test positive where at least 5% of cells are labelled, as visualised by cell staining or other detection of the label. Optionally a higher cut-off such as 10% or 25% may be used. The antibody will generally be used in excess. Reagent antibodies to the molecules of interest are available or may be generated by straightforward methods. To test for ICOS ligand, the antibody MAB1651 is currently available from R&D systems as a mouse IgG that recognises human ICOS ligand. To test for CD20 expression, rituximab may be used. Detection of mRNA levels of the ICOS ligand or target receptor of interest is an alternative technique [33].

A further indication that a tumour will respond to treatment with antibody according to the invention is the presence of Tregs in the tumour microenvironment. Activated Tregs are characterised by ICOS-high and Foxp3-high surface expression. The presence of Tregs in a tumour, especially in elevated numbers, provides a further basis on which a patient may be selected for treatment with the multispecific antibody. Tregs may be detected in a tumour biopsy sample ex vivo, for example by immunohistochemistry (assaying for co-expression of both Foxp3 and ICOS, using antibodies to the target protein followed by detection of labels, as described above) or by single cell dispersion of the sample for use in FACS with labelled antibodies to ICOS and Foxp3. FACS methods are exemplified in Example 17 and Example 18.

Antibodies according to the present invention may be used for treating cancers associated with infectious agents, such as virally-induced cancers. In this category are head and neck squamous cell carcinoma, cervical cancer, Merkel cell carcinoma and many others. Viruses associated with cancer include HBV, HCV, HPV (cervical cancer, oropharyngeal cancer), and EBV (Burkitts lymphomas, gastric cancer, Hodgkin's lymphoma, other EBV positive B cell lymphomas, nasopharyngeal carcinoma and post transplant lymphoproliferative disease). The International Agency for Research on Cancer (Monograph 100B) identified the following major cancer sites associated with infectious agents:
Stomach/Gastric: *Heliobacter pylori*
Liver: Hepatitis B virus, hepatitis C virus (HCV), *Opisthorchis viverrini, Clonorchis sinensis*
Cervix uteri: Human papillomavirus (HPV) with or without HIV
Anogenital (penile, vulva, vagina, anus): HPV with or without HIV
Nasopharynx: Epstein-Barr virus (EBV)
Oropharynx: HPV with or without tobacco or alcohol consumption
Kaposi's sarcoma: Human herpes virus type 8 with or without HIV
Non-Hodgkin lymphoma: H. pylon, EBV with or without HIV, HCV, human T-cell lymphotropic virus type 1
Hodgkin's lymphoma: EBV with or without HIV
Bladder: *Schistosoma haematobium.*

Antibodies according to the present invention may be used for treating cancer associated with or induced by any of these infectious agents, such as the cancers specified above.

Stimulation of effector T cell response can also contribute to immunity against infectious disease and/or to recovery from infectious disease in a patient. Thus, an anti-ICOS antibody may be used for treating infectious disease by administering the antibody to a patient.

Infectious diseases include those caused by pathogens, e.g., bacterial, fungal, viral or protozoal pathogens, and treatment may be to promote immune response in a patient against the pathogen infection. An example of a bacterial pathogen is tuberculosis. Examples of viral pathogens are hepatitis B and HIV. Examples of protozoal pathogens are *Plasmodium* species, which cause malaria, such as *P. falciparum.*

The antibody may be used for treating infections, e.g., infection by any pathogen mentioned herein. Infection may be persistent or chronic infection. Infection may be localised or systemic. Extended contact between a pathogen and the immune system may lead to exhaustion of the immune system or development of tolerance (manifested for example through increased levels of Tregs, and tipping of the Treg:Teff balance in favour of Tregs) and/or to immune evasion by the pathogen, through evolution and modification of displayed pathogen antigens. These features reflect similar processes that are believed to occur in cancer. Anti-ICOS antibodies present a therapeutic approach to treating infection by a pathogen, e.g., chronic infection, through modulation of the Treg:Teff ratio in favour of Teff and/or other effects described herein.

Treatment may be of patients who have been diagnosed as having an infectious disease or an infection. Alternatively, treatment may be preventative, and administered to a patient to guard against contracting a disease, e.g., as a vaccine, as described elsewhere herein.

Further exemplary cancers in humans include a Merkel cell carcinoma, breast cancer, prostate cancer, basal cell carcinoma, biliary tract cancer, bladder cancer, bone cancer, brain and CNS cancer (e.g. glioblastoma), cervical cancer, choriocarcinoma, colon and rectum cancer, connective tissue cancer, cancer of the digestive system; endometrial cancer, esophageal cancer; eye cancer; cancer of the head and neck; nasopharyngeal cancer; gastric cancer; intraepithelial neoplasm; kidney cancer; larynx cancer; leukemia; liver cancer; lung cancer (e.g. small cell and non-small cell); lymphoma including Hodgkin's and Non-Hodgkin's lymphoma including but not limited to DLBCL; Chronic lymphocytic leukaemia, melanoma; uveal melanoma, myeloma, neuroblastoma, oral cavity cancer (e.g., lip, tongue, mouth, and pharynx); ovarian cancer; pancreatic cancer, retinoblastoma; rhabdomyosarcoma; rectal cancer, renal cancer (renal cell carcinoma (RCC)), cancer of the respiratory system; sarcoma, skin cancer; stomach cancer, testicular cancer, thyroid cancer; uterine cancer, cancer of the urinary system, as well as other carcinomas and sarcomas. Further examples of virally induced cancers including; Nasopharyngeal carcinoma, certain Types of NHL (for example but not limited to EBV+ CNS lymphomas, DLBCL and BL, Hodgkins lymphoma (thought to be EBV driven) HPV-related cervical and head an neck squamous cell carcinomas); HBV hepatocellular carcinoma.

Exemplary chronic infections in humans include HIV, hepatitis B virus (HBV), and hepatitis C virus (HCV).

Proliferative or invasion-related diseases that can be treated with the antibodies or antigen binding fragments described herein include neoplastic diseases, and the metastasis associated with such neoplastic disease, such as, melanoma, uveal melanoma, skin cancer, small cell lung cancer, non-small cell lung cancer, salivary gland, glioma, hepatocellular (liver) carcinoma, gallbladder cancer, thyroid tumour, bone cancer, gastric (stomach) cancer, prostate cancer, breast cancer (including triple negative breast cancer), ovarian cancer, cervical cancer, uterine cancer, vulval cancer, endometrial cancer, testicular cancer, bladder cancer, lung cancer, glioblastoma, thyroid cancer, endometrial cancer, kidney cancer, colon cancer, colorectal cancer, pancreatic cancer, esophageal carcinoma, brain/CNS cancers, neuronal cancers, head and neck cancers (including but not limited to squamous cell carcinoma of the head and neck (SCCHN)), mesothelioma, sarcomas, biliary (cholangiocarcinoma), small bowel adenocarcinoma, pediatric malignancies, epidermoid carcinoma, sarcomas, cancer of the pleural/peritoneal membranes and leukaemia, including acute myeloid leukaemia, acute lymphoblastic leukaemia, and multiple myeloma. Treatable chronic viral infections include HIV, hepatitis B virus (HBV), and hepatitis C virus (HCV) in humans, simian immunodeficiency virus (SIV) in monkeys, and lymphocytic choriomeningitis virus (LCMV) in mice.

The can be administered alone, or in combination with other antibodies or chemo therapeutic drugs, radiation therapy or therapeutic vaccines. In one embodiment, the antibody or antigen binding fragment thereof is administered as an antibody-drug conjugate in which the antibody or antigen binding fragment thereof is linked to a drug moiety such as a cytotoxic or cytostatic agent. The use of antibody-drug conjugates for the local delivery of cytotoxic or cytostatic agents in the treatment of cancer allows targeted delivery of the drug moiety to tumours, and intracellular accumulation therein, where systemic administration of unconjugated drug may result in unacceptable levels of toxicity. Drugs in antibody drug conjugates can include, but are not limited to, daunomycin, doxorubicin, methotrexate, and vindesine. Toxins can also be used in antibody-toxin conjugates, including, for example, bacterial toxins such as diphtheria toxin, plant toxins such as ricin, small molecule toxins such as geldanamycin. The toxins may effect their cytotoxic and cytostatic effects by mechanisms including tubulin binding, DNA binding, or topoisomerase.

Still further embodiments include methods of treating a proliferative or invasion-related disease in a mammal by administering to the animal a therapeutically effective dose of an antibody or antigen binding fragment thereof. In another embodiment, the antibodies or antigen binding fragments thereof can be used in a method for treating a mammal suffering from a disease selected from: neoplastic or non-neoplastic disease, chronic viral infection, and a malignant tumour, wherein the method includes administering to the mammal a therapeutically effective dose of an antibody or antigen binding fragment thereof.

Still further embodiments include methods of treating a disease of immunological dysfunction in a mammal by administering to the animal a therapeutically effective dose of an antibody or antigen binding fragment thereof as described herein. Exemplary immunological dysfunction in humans includes diseases of neurological deficit, such as Alzheimer's disease.

It has further been proposed that an immune response, particularly an IFNγ-dependent systemic immune response, could be beneficial for treatment of Alzheimer's disease and other CNS pathologies that share a neuroinflammatory component. WO2015/136541 proposes treatment of Alzheimer's disease using an anti-PD-1 antibody (also see Baruch K. et al., PD-1 immune checkpoint blockade reduces pathology and improves memory in mouse models of Alzheimer's disease, Nature Medicine, 2016, 22(2):137-137).

A multispecific antibody, or composition comprising one, may be used in treating or preventing a disease or condition (which may be a hPD-L1-mediated disease or condition), e.g. selected from neoplastic or non-neoplastic disease, chronic viral infections, and malignant tumours, such as melanoma, Merkel cell carcinoma, non-small cell lung cancer (squamous and non-squamous), renal cell cancer, bladder cancer, head and neck squamous cell carcinoma, mesothelioma, virally induced cancers (such as cervical cancer and nasopharyngeal cancer), soft tissue sarcomas, haematological malignancies such as Hodgkin's and non-Hodgkin's disease and diffuse large B-cell lymphoma (for example melanoma, Merkel cell carcinoma, non-small cell lung cancer (squamous and non-squamous), renal cell cancer, bladder cancer, head and neck squamous cell carcinoma and mesothelioma or for example virally induced cancers (such as cervical cancer and nasopharyngeal cancer) and soft tissue sarcomas). The antibody may be used for the manufacture of a medicament for treating any such condition or others mentioned herein. Methods of treating such a condition in a human are also described, including methods comprising administering to said human a therapeutically effective amount of the antibody, wherein the disease or condition is thereby treated or prevented.

A hPD-L1 mediated disease or condition may be cancer or any disease or condition described herein. In one embodiment, the hPD-L1 mediated disease is a virally induced cancer, such as cervical cancer and nasopharyngeal cancer, for example cervical cancers caused by HPV infection. In one embodiment, the hPD-L1 mediated disease is a chronic viral infection. In one embodiment, the hPD-L1 mediated disease is a neoplastic disease. In one embodiment, the hPD-L1 mediated disease is a non-neoplastic disease. In one embodiment, the hPD-L1 mediated disease is a malignant tumour. In one embodiment, the hPD-L1 mediated disease is a cancer which is known to be responsive to PD-L1 therapy, such as melanoma, Merkel cell carcinoma, non-small cell lung cancer (squamous and non-squamous), renal cell cancer, bladder cancer, head and neck squamous cell carcinoma, mesothelioma. In one embodiment, the hPD-L1 mediated disease is a cancer which is a soft tissue sarcoma.

The hPD-L1-mediated disease or condition may alternatively be a neurodegenerative disease, disorder or condition, optionally wherein the neurodegenerative disease, disorder or condition is selected from Alzheimer's disease, amyotrophic lateral sclerosis, Parkinson's disease, Huntington's disease, primary progressive multiple sclerosis, secondary progressive multiple sclerosis, corticobasal degeneration, Rett syndrome, a retinal degeneration disorder selected from age-related macular degeneration and retinitis pigmentosa; anterior ischemic optic neuropathy, glaucoma, uveitis, depression, trauma-associated stress or post-traumatic stress disorder, frontotemporal dementia, Lewy body dementias, mild cognitive impairments, posterior cortical atrophy, primary progressive aphasia and progressive supranuclear palsy or aged-related dementia, in particular Alzheimer's disease, amyotrophic lateral sclerosis, Parkinson's disease and Huntington's disease, and e.g. Alzheimer's disease.

Methods of treatment may further comprise administering to the human a further therapy, for example a further therapeutic agent, optionally wherein the further therapeutic agent is independently selected from the group consisting of:
a. other immune checkpoint inhibitors (such as anti-TIM-3 antibodies, anti-CTLA-4 antibodies, anti-TIGIT antibodies and anti-LAG-3 antibodies);
b. immune stimulators (such as anti-OX40 antibodies, anti-GITR antibodies, anti-CD137 antibodies, anti-ICOS antibodies and anti-CD40 antibodies);
c. chemokine receptor antagonists (such as CXCR4, CCR4 and CXCR2);
d. targeted kinase inhibitors (such as CSF-1R or VEGFR inhibitors);
e. angiogenesis inhibitors (such as anti-VEGF-A or Delta-like Ligand-4);
f. immune stimulating peptides or chemokines (such as CXCL9 or CXCL10);
g. cytokines (such as IL-15 and IL-21);
h. bispecific T-cell engagers (BiTEs) having at least one specificity against CD3 (e.g. CD3/CD19 BiTE);
i. other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
j. oncolytic viruses (such as HSV virus (optionally which secretes GMCSF), Newcastle disease virus and Vaccinia virus);
k. vaccination with tumour associated antigens (such as New York Esophageal Cancer-1 [NY-ESO-1], Melanoma Associated Antigen-3 [MAGE-3]);
l. cell-based therapies (such as chimeric Antigen Receptor-T cells (CAR-T) for example expressing anti-CD19, anti-EpCam or anti-mesothelin);
m. bispecific NK cell engagers having a specificity against an activating MK receptor such as NKG2D or CD16a; and
n. adoptive transfer of tumour specific T-cells or LAK cells,
or optionally wherein the further therapy is chemotherapy, radiotherapy and surgical removal of tumours. Radiotherapy may be single dose or in fractionated doses, either delivered to affected tissues directly or to the whole body.

Chemotherapeutic agents may any as described hereinabove, in particular agents that induce immunogenic cell death, for example platinum therapies, such as oxaliplatin. In one embodiment, the chemotherapy is a standard of care cytotoxic chemotherapy for the cancer being treated.

The further therapeutic agents of this concept may be delivered by any method, which methods are well-known to those skilled in the art. For example, the further therapeutic agents may be delivered orally, systemically or locally (to the tumour environment). In one embodiment, the further therapeutic agent is delivered orally. In one embodiment, the further therapeutic agent is delivered systemically (e.g. intravenously). In one embodiment, the further therapeutic agent is delivered locally to the tumour environment.

Compositions and routes of administration are described in more detail hereinbelow.

The further therapeutic agent is administered sequentially or simultaneously with the multispecific antibody.

A pharmaceutical composition may comprise a multispecific antibody as described herein and a pharmaceutically acceptable excipient, diluent or carrier, optionally further comprising a further therapeutic agent independently selected from the group consisting of:
a) other immune checkpoint inhibitors (such as anti-TIM-3 antibodies, anti-CTLA-4 antibodies, anti-TIGIT antibodies and anti-LAG-3 antibodies);
b) immune stimulators (such as anti-OX40 antibodies, anti-GITR antibodies, anti-CD137 antibodies, anti-ICOS antibodies and anti-CD40 antibodies);
c) chemokine receptor antagonists (such as CXCR4, CCR4 and CXCR2);
d) targeted kinase inhibitors (such as CSF-1R or VEGFR inhibitors);
e) angiogenesis inhibitors (such as anti-VEGF-A or Delta-like Ligand-4);
f) immune stimulating peptides or chemokines (such as CXCL9 or CXCL10);
g) cytokines (such as IL-15 and IL-21);
h) bispecific T-cell engagers (BiTEs) having at least one specificity against CD3 (e.g. CD3/CD19 BiTE);
i) other bi-specific molecules (for example IL-15-containing molecules targeted towards tumour associated antigens, for example Epidermal growth factor receptors such as EGFR, Her-2, New York Esophageal Cancer-1 (NY-ESO-1), GD2, EpCAM or Melanoma Associated Antigen-3 (MAGE-A3));
j) oncolytic viruses (such as HSV virus (optionally which secretes GMCSF), Newcastle disease virus and Vaccinia virus);
k) vaccination with tumour associated antigens (such as New York Esophageal Cancer-1 [NY-ESO-1], Melanoma Associated Antigen-3 [MAGE-3]);
l) cell-based therapies (such as chimeric Antigen Receptor-T cells (CAR-T) for example expressing anti-CD19, anti-EpCam or anti-mesothelin);
m) bispecific NK cell engagers having a specificity against an activating MK receptor such as NKG2D or CD16a;
and
n) adoptive transfer of tumour specific T-cells or LAK cells.

Pharmaceutical formulations are well-known to those skilled in the art. In one embodiment, the antibody or fragment is administered intravenously. In one embodiment, the antibody or fragment is administered subcutaneously.

In an example, an antibody or fragment as disclosed herein is contained in a medical container, e.g., a vial, syringe, IV container or an injection device (such as an intraocular or intravitreal injection device). In an example, the antibody or fragment is in vitro, for example, in a sterile container.

In one embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocamne to ease pain at the site of the injection. Such compositions, however, may be administered by a route other than intravenous. Generally, the ingredients of compositions are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The further therapeutic agents of this concept may be delivered by any method, which methods are well-known to those skilled in the art. For example, the further therapeutic agents may be delivered orally, systemically or locally (to the tumour environment). In one embodiment, the further therapeutic agent is delivered orally. In one embodiment, the further therapeutic agent is delivered systemically (e.g. intravenously). In one embodiment, the further therapeutic agent is delivered locally to the tumour environment.

Encoding Nucleic Acids and Methods of Expression

Isolated nucleic acid may be provided, encoding antibodies according to the present invention. Nucleic acid may be DNA and/or RNA. Genomic DNA, cDNA, mRNA or other RNA, of synthetic origin, or any combination thereof can encode an antibody.

The present invention provides constructs in the form of plasmids, vectors, transcription or expression cassettes which comprise at least one polynucleotide as above. Exemplary nucleotide sequences are included in the sequence listing. Reference to a nucleotide sequence as set out herein encompasses a DNA molecule with the specified sequence, and encompasses a RNA molecule with the specified sequence in which U is substituted for T, unless context requires otherwise.

The present invention also provides a recombinant host cell that comprises one or more nucleic acids encoding the antibody. Methods of producing the encoded antibody may comprise expression from the nucleic acid, e.g., by culturing recombinant host cells containing the nucleic acid. The antibody may thus be obtained, and may be isolated and/or purified using any suitable technique, then used as appropriate. A method of production may comprise formulating the product into a composition including at least one additional component, such as a pharmaceutically acceptable excipient.

Systems for cloning and expression of a polypeptide in a variety of different host cells are well known. Suitable host cells include bacteria, mammalian cells, plant cells, filamentous fungi, yeast and baculovirus systems and transgenic plants and animals.

The expression of antibodies and antibody fragments in prokaryotic cells is well established in the art. A common bacterial host is *E. coli*. Expression in eukaryotic cells in culture is also available to those skilled in the art as an option for production. Mammalian cell lines available in the art for expression of a heterologous polypeptide include Chinese hamster ovary (CHO) cells, HeLa cells, baby hamster kidney cells, NSO mouse melanoma cells, YB2/0 rat myeloma cells, human embryonic kidney cells, human embryonic retina cells and many others.

Vectors may contain appropriate regulatory sequences, including promoter sequences, terminator sequences, polyadenylation sequences, enhancer sequences, marker genes and other sequences as appropriate. Nucleic acid encoding an antibody can be introduced into a host cell. Nucleic acid can be introduced to eukaryotic cells by various methods, including calcium phosphate transfection, DEAE-Dextran, electroporation, liposome-mediated transfection and transduction using retrovirus or other virus, e.g. vaccinia or, for insect cells, baculovirus. Introducing nucleic acid in the host cell, in particular a eukaryotic cell may use a viral or a plasmid based system. The plasmid system may be maintained episomally or may be incorporated into the host cell or into an artificial chromosome. Incorporation may be either by random or targeted integration of one or more copies at single or multiple loci. For bacterial cells, suitable techniques include calcium chloride transformation, electroporation and transfection using bacteriophage. The introduction may be followed by expressing the nucleic acid, e.g., by culturing host cells under conditions for expression of the gene, then optionally isolating or purifying the antibody.

Nucleic acid of the invention may be integrated into the genome (e.g. chromosome) of the host cell. Integration may be promoted by inclusion of sequences that promote recombination with the genome, in accordance with standard techniques.

The present invention also provides a method that comprises using nucleic acid described herein in an expression system in order to express an antibody.

EXAMPLES

A number of bispecific antibodies were generated, using different antibody formats, and with different anti-ICOS and anti-PD-L1 binding sites. Bispecific antibodies were shown to bind and induce an agonistic signal at ICOS, to bind to PD-L1 inhibiting the interaction with PD-1, and to deplete cells expressing high levels of ICOS.

Anti-ICOS Fv regions of antibodies, and anti-PD-L1 Fv regions of antibodies, can be generated using the Kymouse—a transgenic mouse technology platform. Kymouse covers the entire human immunoglobulin (Ig) repertoire of V, D and J genes required to make fully human antibodies. On selection and recovery of recombined variable regions, the antibodies are re-formatted to yield antibodies with isotypes or Fc-domains of choice. STIM001 and STIM003 are anti-ICOS antibodies originating from the Kymouse. Their Fv regions were included in bispecific antibody formats as described in these Examples.

The example anti-PD-L1 binding domains that were used in the mAb$^2$ bispecific antibodies described in these Examples were produced as Fcabs, utilising permissive residues in the CH3 domain of the constant chain of human IgG1 termed the AB, CD and EF loops to generate IgG-based Fcabs which bind PD-L1.

Example 1 Generation of ICOS/PD-L1 Bispecific Antibody

FIT-Ig

Bispecific antibodies for ICOS and PD-L1 were generated in FIT-Ig format, as illustrated in FIG. 2.

The anti-PD-L1/ICOS tetravalent bispecific FIT-Ig molecule combines the variable regions of an anti-ICOS antibody with the variable regions of an anti-PD-L1 antibody. The bispecific molecule presents two Fabs in tandem, fused with an Fc. The molecules are symmetrical.

In this example, the anti-ICOS antibody domains were those of STIM003 and the anti-PD-L1 antibody domains were those of Antibody W. The FIT-Ig molecules were generated with anti-ICOS binding specificity as the "outer" Fab (antibody A in FIG. 2) or with anti-ICOS binding specificity as the "inner" Fab (antibody B in FIG. 2). Fc domains were either human IgG1 or mouse IgG2a. Thus a total of four different FIT-Ig molecules were produced using the STIM003 and AbW binding specificities:

ICOS/PD-L1 hIgG1
ICOS/PD-L1 mIgG2a
PD-L1/ICOS hIgG1
PD-L1/ICOS mIgG2a

For each FIT-Ig molecule, the three constructs shown in FIG. 2(ii) were generated, and cloned into an expression vector (pTT5) via restriction enzymes and sequences were verified. A 30 mL HEK transient transfection was then performed, using the three constructs in 1:1:1 ratio. After 6 days, supernatant was analysed to assess the level of expression, quantifying using human IgG1 and mouse IgG2a as standards. Expression data are shown in Table E1-1 below.

TABLE E1-1

| Expression of FIT-Ig in µg/mL. | | |
|---|---|---|
| Standard human IgG1 | STIM003_AbW_hIgG1 | 11.1 |
|  | AbW_STIM003_hIgG1 | 52.5 |
| Standard mouse IgG2a | STIM003_AbW_mIgG2a | 44.2 |
|  | AbW_STIM003_mIgG2a | 42.8 |

Sequences of further example FIT-Ig molecules are shown in Table S3.

mAb$^2$

Figure 3:
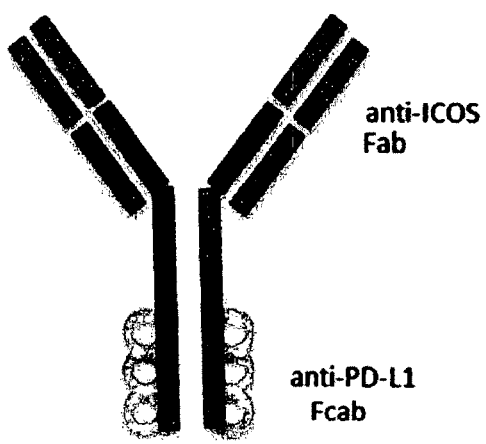
FIG. 3. Example mAb$^2$ IgG format of bispecific antibody that binds ICOS and PD-L1. The mAb$^2$ is a homodimeric IgG comprising two anti-ICOS Fab and two CH3 domains each having three binding loops forming a PD-L1 binding site (the anti-PD-L1 Fcab region).

Bispecific antibodies for ICOS and PD-L1 were generated in mAb$^2$ format, as illustrated in FIG. 3. The following molecules were generated and expressed:

STIM001_289. A mAb$^2$ IgG1 in which the two Fab regions comprise the VH and VL domains of anti-ICOS antibody STIM001 and the Fcab region binds human PD-L1.

STIM001_457. A mAb$^2$ IgG1 in which the two Fab regions comprise the VH and VL domains of anti-ICOS antibody STIM001 and the Fcab region binds mouse PD-L1.

STIM003_289. A mAb$^2$ IgG1 in which the two Fab regions comprise the VH and VL domains of anti-ICOS antibody STIM003 and the Fcab region binds human PD-L1.

STIM003_457. A mAb$^2$ IgG1 in which the two Fab regions comprise the VH and VL domains of anti-ICOS antibody STIM003 and the Fcab region binds mouse PD-L1.

STIM003_574. A mAb$^2$ IgG1 in which the two Fab regions comprise the VH and VL domains of anti-ICOS antibody STIM003 and the Fcab region binds mouse PD-L1.

The Fcab regions of _457 and _574 have a minor variation in amino acid sequence. In vitro, the affinity of 457 to mouse PD-L1 is lower compared with that of 574. The affinity of 574 for mouse PD-L1 is closer to the affinity of 289 for human PD-L1. In vivo, 457 and 574 have similar anti-tumour efficacy.

The following control antibodies were also generated for use in the experiments:

IgG1_289. A mAb$^2$ IgG1 in which the two Fab regions do not bind ICOS or PD-L1, and the Fcab region binds human PD-L1.

IgG1_457. A mAb$^2$ IgG1 in which the two Fab regions do not bind ICOS or PD-L1, and the Fcab region binds mouse PD-L1.

IgG1_438. A mAb$^2$ IgG1 in which the two Fab regions do not bind ICOS or PD-L1, and the Fcab region binds mouse PD-L1. IgG1_438 and IgG1_457 have minor variation in the amino acid sequences of the antigen-binding loops in the Fcab and are functionally equivalent for the purposes of the assays described below.

The mAb$^2$ antibodies were generated as IgG1, containing IgG1 CH1, CH2 and CH3 constant regions, with the Fcab binding loops in the IgG1 CH3 constant region. Unless otherwise stated, IgG1 was wild type human IgG1. The "LAGA" variant IgG1 sequence was used where specified. The "LAGA" variant includes mutations L235A and G237A which disable Fc-mediated effects ADCC and CDC as described in WO99/58679 and in Shields et al. J. Biol. Chem., March 2; 276(9):6591-604 2001.

Example 2 Kinetic Surface Plasmon Resonance (SPR) Assay for Characterisation of Bispecific Antibody Binding to ICOS and PD-L1

Analysis of mAb$^2$ Binding to Human PD-L1 and Mouse PD-L1

This kinetic SPR assay confirmed that addition of human variable regions to anti-PD-L1 Fcab molecules to create mAb$^2$ constructs did not affect the ability of the Fcab to recognise PD-L1. Six different mAb$^2$_289 constructs exhibited similar binding to human PD-L1, and six different mAb$^2$_457 constructs exhibited similar binding to mouse PD-L1.

Method:

An anti-human IgG capture surface was created on a Series S C1 chip (GE Healthcare, cat No BR100535). A cocktail of three anti-human IgG antibodies were covalently coupled to the biosensor chip surface (Jackson Labs: cat No 109-005-008; cat No 309-006-008 and cat No 109-006-008), using 10 mM Na Acetate pH 4.5 buffer as the diluent for the antibody.

For the kinetic assay, mAb$^2$ constructs were diluted to 5 µg/mL in running buffer (1×HBS-EP+ Buffer Technova, cat. No. H8022) and captured on the anti-human capture surface. The human recombinant extra cellular domain PD-L1 protein was used as analyte at 81 nM, 27 nM, 9 nM, 3 nM, 1 nM and 0 nM, and injected over the mAb$^2$_289 constructs. The mouse recombinant extra cellular domain PD-L1 protein was injected as analyte at 243 nM, 81 nM, 27 nM, 9 nM, 3 nM, 1 nM and 0 nM over the mAb$^2$_457 constructs. Finally, the surface was regenerated between each mAb$^2$ construct using 100 mM PO$_4$. The assay was carried out at 25° C.

The buffer injection (i.e. 0 nM) was used to double reference the sensorgrams. The analysis was carried out using the 1:1 binding model inherent to the Biacore 8K's analysis software.

Results:

Data for binding to human PD-L1 are shown in Table E2-1 below.

TABLE E2-1 mAb$^2$_289 affinities for binding to human PD-L1. Five concentrations of human PD-L1 (81, 27, 9, 3 and 1 nM) were used as analyte over each mAb$^2$_289 construct, captured at 5 µg/mL.

|  | ka (1/Ms) | kd (1/s) | KD (nM) |
|---|---|---|---|
| hybrid control_289 | 8.99E+06 | 1.84E−03 | 0.20 |
| hybrid control_289_LAGA | 8.14E+06 | 1.40E−03 | 0.17 |
| STIM003_289 | 5.31E+06 | 1.38E−03 | 0.26 |
| STIM003_289_LAGA | 8.69E+06 | 1.63E−03 | 0.19 |
| STIM001_289 | 8.94E+06 | 1.87E−03 | 0.21 |
| STIM001_289_LAGA | 7.68E+06 | 1.47E−03 | 0.19 |

With respect to the K$_D$ values, the binding of the mAb$^2$_289 constructs to human PD-L1 was comparable and within the variance expected with this type of assay.

Data for binding to mouse PD-L1 are shown in Table E2-2 below.

TABLE E2-2 mAb$^2$_457 affinities for binding to mouse PD-L1. Six concentrations of mouse PD-L1 (243, 81, 27, 9, 3 and 1 nM) were used as analyte over each mAb$^2$_457 construct, captured at 5 µg/mL.

| | ka (1/Ms) | kd (1/s) | KD (nM) |
|---|---|---|---|
| STIM003_457 | 1.31E+06 | 1.07E−01 | 82.0 |
| STIM003_457_LAGA | 1.36E+06 | 1.30E−01 | 95.9 |
| STIM001_457 | 1.32E+06 | 1.29E−01 | 97.8 |
| STIM001_457_LAGA | 2.11E+06 | 2.27E−01 | 107.8 |
| hybrid control_457 | 1.35E+06 | 1.34E−01 | 99.3 |
| hybrid control_457_LAGA | 1.32E+06 | 1.43E−01 | 108.7 |

With respect to the $K_D$ values, the binding of the mAb$^2$_457 constructs to mouse PD-L1 is comparable. However, given that the apparent affinity of the interaction is in the 80-110 nM range and the top concentration of mouse recombinant extra cellular domain PD-L1 was only 243 nM, it is unlikely that a true saturated Rmax was achieved in this assay, hence the actual affinity may be lower than indicated by these data. Nevertheless it can be concluded that the constructs are comparable in their binding and the anti-PD-L1 Fcab retains its binding for mouse PD-L1 when incorporated into a mAb$^2$ format.

Avidity Surface Plasmon Resonance Analysis of mAb$^2$ Binding to Human ICOS

This avidity SPR assay confirmed that the bispecific mAb$^2$ constructs were able to bind ICOS. Values obtained for binding were similar across all samples tested and within experimental variance for this type of assay, where capture level, concentration and biophysical form can have an impact on values.

Method:

Biotinylated human ICOS protein diluted at 7.5 µg/mL in running buffer (1×HBS-EP+ Buffer Technova, cat. No. H8022) was captured on a NLC sensor chip (Bio-Rad, cat No 1765021). The surface was then blocked using biocytin (Sigma Aldrich, cat No B1758) at 1 mg/mL.

The ICOS/PD-L1 bispecific mAb$^2$ and the corresponding human anti-ICOS IgG1 constructs were injected as analyte at 500, 167, 56, 18.5 and 0 nM for the STIM001_mAb$^2$ and STIM001, and at 40, 10, 2.5, 0.625 and 0 nM for the STIM003_mAb$^2$ and STIM003. The assay was carried out at 25° C.

The buffer injection (i.e. 0 nM) was used to double reference the sensorgrams. The analysis was carried out using the equilibrium model inherent to the ProteOn's analysis software for each mAb$^2$ construct.

Results:

Data for STIM003 mAb$^2$ constructs binding to human ICOS are shown in Table E2-3.

TABLE E2-3

Apparent affinities of STIM003_mAb$^2$ for binding to human ICOS. Four concentrations of STIM003_mAb$^2$ and STIM003 (40, 10, 2.5 and 0.625 nM) were used as analyte over the human ICOS protein, captured at 7.5 µg/mL.

| mAb$^2$ | Capture level (RU) | Apparent KD (nM) from equilibrium | Off-rate (1/s) | Calculated On-rate (1/M · s) |
|---|---|---|---|---|
| STIM003_289 | 528 | 0.7 | 2.65E−04 | 3.55E+05 |
| STIM003_289_LAGA | 548 | 0.6 | 2.78E−04 | 4.77E+05 |
| STIM003_457 | 1122 | 0.9 | 2.44E−04 | 2.75E+05 |

TABLE E2-3-continued

Apparent affinities of STIM003_mAb$^2$ for binding to human ICOS. Four concentrations of STIM003_mAb$^2$ and STIM003 (40, 10, 2.5 and 0.625 nM) were used as analyte over the human ICOS protein, captured at 7.5 µg/mL.

| mAb$^2$ | Capture level (RU) | Apparent KD (nM) from equilibrium | Off-rate (1/s) | Calculated On-rate (1/M · s) |
|---|---|---|---|---|
| STIM003_457_LAGA | 935 | 0.8 | 2.32E−04 | 2.84E+05 |
| STIM003 | 543 | 1.7 | 4.49E−04 | 2.67E+05 |

Data for STIM001 mAb$^2$ constructs binding to human ICOS are shown in Table E2-4.

TABLE E2-4

Apparent affinities of STIM001_mAb$^2$ for binding to human ICOS. Four concentrations of STIM001_mAb$^2$ and STIM001 (500, 167, 56 and 18.5 nM) were used as analyte over the human ICOS protein, captured at 7.5 µg/mL.

| mAb$^2$ | Capture level (RU) | Apparent KD (nM) from equilibrium | Off-rate (1/s) | Calculated On-rate (1/M · s) |
|---|---|---|---|---|
| STIM001_289 | 712 | 19.1 | 4.18E−04 | 2.19E+04 |
| STIM001_289_LAGA | 1166 | 25.4 | 3.54E−04 | 1.39E+04 |
| STIM001_457 | 1011 | 9.2 | 3.46E−04 | 3.76E+04 |
| STIM001_457_LAGA | 716 | 10.6 | 3.32E−04 | 3.13E+04 |
| STIM001 | 730 | 57.1 | 4.56E−04 | 7.99E+03 |

In conclusion, these data indicate that the presence of the PD-L1 binding site in the bispecific molecule does not affect binding of the anti-ICOS Fab arms.

Example 3 ELISA Characterisation of Bispecific Antibody Binding to ICOS and PD-L1

Antibodies in mAb$^2$ format were assessed for binding to recombinant human ICOS, mouse ICOS, human PD-L1 and mouse PD-L1 proteins. Binding of the ICOS/PD-L1 bispecific mAb$^2$ antibodies to recombinant ICOS protein and recombinant PD-L1 protein was confirmed in this assay.

DELFIA ELISA Method:

Recombinant ICOS proteins, human ICOS-mFc or mouse ICOS-mFc (Chimerigen) were diluted in 1×PBS and added to Black Hi-bind plates (Griener) at 1 µg/ml, 50 µl/well. Recombinant PD-L1 proteins, human PD-L1-Flag-His or mouse-His were diluted in 1×PBS and added to Black Hi-bind plates (Griener) at 4 µg/ml, 50 µl/well. The plates were left overnight at 4° C. The next day plates were washed 3× with 300 µl/well of 1×PBS+0.1% Tween and blocked with 200 ul/well of 1×PBS+1% BSA blocking buffer for 1 hr at RT on a plate shaker. Plates were washed 3× with 300 µl/well of 1×PBS+0.1% Tween.

In general, antibodies in monoclonal and mAb$^2$ format were diluted in 1×PBS+0.1% BSA buffer and diluted 1 in 3 from starting working concentration of either 0.399 µM, 0.199 µM over a 11 point titration. However, human-PD-L1 mAb$^2$ antibodies were diluted in 1×PBS+0.1% BSA buffer and diluted 1 in 2 from a starting working concentration of 0.066 µM over an 11 point titration. Titrated antibodies were added to the plates, 50 µl/well and left to incubate for 1 hr at R.T on a plate shaker. Plates were washed 3× with 300 µl/well of 1×PBS+0.1% Tween.

DELFIA® Eu-labelled Anti-human IgG (Perkin-Elmer) was diluted 1:500 in DELFIA Assay buffer (Perkin-Elmer) and added to the assay plate (50 μl/well), left to incubate for 1 hr at RT on a plate shaker. Plates were then washed 3× with 300 μl/well 1×DELFIA wash buffer before the addition of 50 μl/well of DELFIA Enhancement Solution (Perkin-Elmer), incubated for a minimum of 5 minutes in the dark. After incubation, assay was read on Envision plate reader (Perkin Elmer), Time-resolved fluorescence (TRF) was measured at 615 nm.

Titration curves and EC50 values [M] were plotted using Graphpad (Prism). EC50 values were calculated by first transforming the data using equation X=Log(X). The transformed data was then fitted using nonlinear regression, using fitting algorithm, log (agonist) vs. response-variable slope (four parameters).

Results:

Data are summarised in Tables E3-1 to E3-4 and shown in FIG. 4.

In the human ICOS ELISA assay STIM003_289 and STIM003_457 produced similar EC50 values to STIM003 (mean EC50 values; 0.63 nM±0.18 nM and 0.43±0.069 nM and 0.75±0.27 nM respectively).

In the human ICOS ELISA assay STIM001_289 and STIM001_457 produced similar EC50 values to STIM001 (mean EC50 values; 13.1 nM±6.5 nM and 12.5±3.12 nM and 28.9±11 nM respectively).

In the mouse ICOS ELISA assay STIM003_289 and STIM003_457 produced similar EC50 values to STIM003 (mean EC50 values; 0.42 nM±0.075 nM and 0.28±0.037 nM and 0.37±0.039 nM respectively).

STIM001_289 and STIM001_457 produced similar EC50 values in the human ICOS ELISA assay (mean EC50 values; 13.16 nM±6.50 nM and 12.55 nM±3.12 nM respectively).

STIM003_289 and STIM003_457 produced similar EC50 values in the mouse ICOS ELISA assay (mean EC50 values; 0.42 nM±0.075 nM and 0.28±0.037 nM respectively).

STIM003_289 and STIM003_457 gave more robust N=3 EC50 values due to a higher max assay signal and better sigmoidal curve, not observed for STIM001_289 and STIM001_457 in the mouse ICOS ELISA assay.

STIM001_289, STIM003_289 and hybrid control_289 produced similar EC50 values in the human PD-L1 ELISA assay (mean EC50 values; 1.57 nM±0.32 nM, 1.43 nM±0.16 nM and 1.45 nM±0.28 nM respectively).

STIM001_457, STIM003_457 produced similar EC50 values in the mouse PD-L1 ELISA assay (mean EC50 values; 3.84 nM±1.87 nM, 6.83 nM±1.38 nM respectively).

TABLE E3-1

| hICOS Best-Fit values | N = 1 EC50 (M) | N = 2 EC50 (M) | N = 3 EC50 (M) | Mean (M) | STDEV (M) | SEM (M) |
| --- | --- | --- | --- | --- | --- | --- |
| STIM003_289 | 4.908E-10 | 5.622E-10 | 8.406E-10 | 6.312E-10 | 1.84804E-10 | 1.06697E-10 |
| STIM001_289 | 9.812E-09 | 9.013E-09 | 2.066E-08 | 1.316E-08 | 6.50816E-09 | 3.75749E-09 |
| STIM003_457 | 5.098E-10 | 3.800E-10 | 4.006E-10 | 4.301E-10 | 6.97426E-11 | 4.02659E-11 |
| STIM001_457 | 1.315E-08 | 1.533E-08 | 9.169E-09 | 1.255E-08 | 3.12347E-09 | 1.80333E-09 |
| STIM003 | 4.880E-10 | 1.037E-09 | 7.270E-10 | 7.507E-10 | 2.75385E-10 | 1.58994E-10 |
| STIM001 | 2.002E-08 | 2.549E-08 | 4.128E-08 | 2.893E-08 | 1.10422E-08 | 6.3752E-09 |

TABLE E3-2

| mICOS Best-Fit values | (N = 1) EC50 (M) | (N = 2) EC50 (M) | (N = 3) EC50 (M) | Mean (M) | STDEV (M) | SEM (M) |
| --- | --- | --- | --- | --- | --- | --- |
| STIM003_289 | 3.358E-10 | 4.775E-10 | 4.529E-10 | 4.221E-10 | 7.56844E-11 | 4.36964E-11 |
| STIM001_289 | 2.057* | 2.270E-09 | 2.163E-09 | 2.217E-09 | 7.55591E-11 | 4.36241E-11 |
| STIM003_457 | 3.265E-10 | 2.518E-10 | 2.881E-10 | 2.888E-10 | 3.73468E-11 | 2.15622E-11 |
| STIM001_457 | 2.360E-08 | 5.80E-07* | 437.58* | 2.360E-08 | | |
| STIM003 | 4.16E-10 | 3.86E-10 | 3.38E-10 | 3.799E-10 | 3.94138E-11 | 2.27555E-11 |
| STIM001 | 1.14E-08 | 1.87E-08 | 1.73E-09 | 1.140E-08 | 8.4999E-09 | 4.90742E-09 |

*data excluded due to incomplete curve fit.

TABLE E3-3

| hPD-L1 Best-Fit values | N = 1 EC50 (M) | N = 2 EC50 (M) | N = 3 EC50 (M) | Mean (M) | STDEV (M) | SEM (M) |
| --- | --- | --- | --- | --- | --- | --- |
| STIM003_289 | 1.23E-09 | 1.53E-09 | 1.52E-09 | 1.43E-09 | 1.69084E-10 | 9.76206E-11 |
| STIM001_289 | 1.48E-09 | 1.30E-09 | 1.93E-09 | 1.57E-09 | 3.25612E-10 | 1.87992E-10 |
| Hybrid Control_289 | 1.16E-09 | 1.46E-09 | 1.73E-09 | 1.45E-09 | 2.89106E-10 | 1.66915E-10 |
| AbV | 8.34E-10 | 8.18E-10 | 1.13E-09 | 9.28E-10 | 1.76778E-10 | 1.02063E-10 |

TABLE E3-4

| mPD-L1 Best-values | N = 1 EC50 (M) | N = 2 EC50 (M) | N = 3 EC50 (M) | Mean (M) | STDEV (M) | SEM (M) |
| --- | --- | --- | --- | --- | --- | --- |
| STIM003_457 | 5.81743E-09 | 8.40577E-09 | 6.28E-09 | 6.836E-09 | 1.380E-09 | 7.965E-10 |
| STIM001_457 | 5.6504E-09 | 3.97431E-09 | 1.91E-09 | 3.845E-09 | 1.874E-09 | 1.082E-09 |
| AbV | 1.38E-09 | 9.99E-10 | 8.66E-10 | 1.080E-09 | 2.644E-10 | 1.527E-10 |

Example 4 FACS Characterisation of Bispecific Antibody Binding to Cells Expressing ICOS or PD-L1

CHO Human ICOS and CHO Mouse ICOS Binding Assay (Flow Cytometry)

Ability of the ICOS/PD-L1 mAb$^2$ to bind human ICOS and mouse ICOS on the surface of CHO cells was confirmed in this assay. STIM001_289 mAb$^2$ and STIM003_289 mAb$^2$ were assessed for binding to transfected human ICOS and mouse ICOS CHO cells. Antibody binding to cells was detected with anti-human IgG labelled AlexaFluor 647.

Method:

CHO-S cells transfected with either human ICOS or mouse ICOS were resuspended in FACS buffer (PBS+1% w/v BSA+0.1% w/v sodium azide) and transferred to a 96-well V-bottom plate (Greiner) at a density of 1×10$^5$ cells per well. mAb and mAb$^2$ were titrated in FACS buffer, 1 in 3 dilution across 11 points from a starting working concentration of 400 nM. Plates were centrifuged at 300×g for 3 minutes, supernatant discarded and 50 μL mAb or mAb$^2$ solution were added to cells and incubated at 4° C. for 1 hour. Cells were washed with 150 μL of PBS and centrifuged at 300×g for 3 minutes, supernatant was discarded and cell pellet resuspended in 150 μL PBS added. This wash step was repeated twice. Bound mAb or mAb$^2$ was detected by addition of 50 μL of anti-human 647 (Jackson ImmunoResearch) diluted to 3 ug/ml in FACS buffer. Cells were incubated for 1 hour at 4° C. in the dark. Cells were washed with 150 μL of PBS and centrifuged at 300 g for 3 minutes, supernatant was discarded and cell pellet resuspended in 150 μL PBS added. This wash step was repeated twice. Cells were fixed with 25 μL 4% v/v paraformaldehyde, incubated for 20 minutes at 4° C., cells were pelleted by centrifugation at 300×g and the supernatant discarded. Cells were washed with 150 μL of PBS and centrifuged at 300 g for 3 minutes, supernatant was discarded and cell pellet resuspended in 150 μL PBS added. This wash step was repeated. Pelleted cells were resuspended in 110 μL 1×PBS. AlexaFluor 647 signal intensity (geometric mean) was measured by flow cytometry using a Beckman Coulter CytoFLEX instrument.

Results:

EC50 data for binding to human ICOS are shown in Table E4-1 below and in FIG. 5 (A).

CHO Human PD-L1 Binding Assay Assay (Flow Cytometry)

Ability of the ICOS/PD-L1 mAb$^2$ to bind human PD-L1 expressed on the surface of CHO cells was confirmed in this assay. Binding of the bispecific antibody to PD-L1 could be detected using labelled ICOS recombinant protein, confirming the ability of the bispecific antibodies to bind both PD-L1 and ICOS.

STIM001_289 and STIM003_289 and one isotype control (IgG1_289) were assessed for human PD-L1 binding using FACS. These were characterised using anti-human IgG and human ICOS labelled AlexaFluor 647 detection.

Method:

CHO-S cells untransfected (referred to as WT) or transfected with the cDNA coding for human PD-L1 were diluted in FACS buffer (PBS+1% w/v BSA+0.1% w/v sodium azide) and were distributed to a 96-well V-bottom plate (Greiner) at a density of 5×10$^4$ cells per well. Antibody and mAb$^2$ titrations were prepared from 198 nM working concentration as a 1/3 dilution series in FACS buffer. Plates were centrifuged at 300×g for 3 minutes to supernatant aspirated. 50 μL antibody or mAb$^2$ solution were added to cells and incubated at 4° C. for 1 hour. Cells were washed with 150 μL of PBS and centrifuged at 300 g for 3 minutes. Supernatant was aspirated and 150 μL PBS added. This wash step was repeated. Presence of bound antibody or mAb$^2$ was detected by addition of 50 μL of Anti-Human PE (Jackson ImmunoResearch) diluted 1/500 in FACS buffer or human ICOS labelled AlexaFluor 647 diluted to 225 nM to each well. Cells were incubated for 1 hour at 4° C. in the dark. Cells were washed as previously described. To fix cells, 100 μL 4% v/v paraformaldehyde was added and cells incubated for 20 minutes at 4° C., cells were pelleted by centrifugation at 300×g and the plates resuspended in 100 μL FACS buffer. AlexaFluor 647 and PE (R-Phycoerythrin) signal intensity (geometric mean) was measured by flow cytometry using a Beckman Coulter CytoFLEX instrument.

Results:

Bispecific antibodies and isotype control produced similar EC50 values to each other in the anti-human IgG detection system (0.64 nM, 0.64 nM and 0.55 nM respectively)—FIG. 6 (A). Bispecific antibodies produced similar EC50 values to each other in the human ICOS labelled AlexaFluor 647 system (0.48 nM and 0.58 nM respectively)—FIG. 6 (B). As expected, the isotype control antibody did not bind ICOS.

TABLE E4-1

| hICOS Best-Fit value | N = 1 EC50 (M) | N = 2 EC50 (M) | N = 3 EC50 (M) | Mean (M) | STDEV (M) | SEM (M) |
|---|---|---|---|---|---|---|
| STIM003_289 | 5.696E−09 | 2.282E−09 | 6.792E−09 | 4.924E−09 | 2.352E−09 | 1.358E−09 |
| STIM001_289 | 5.529E−09 | 2.982E−09 | 3.134E−09 | 3.882E−09 | 1.429E−09 | 8.249E−10 |
| STIM003 | 7.220E−09 | 4.890E−09 | 4.485E−09 | 5.532E−09 | 1.476E−09 | 8.522E−10 |
| STIM001 | 3.009E−08 | 1.380E−08 | 1.973E−08 | 2.121E−08 | 8.244E−09 | 4.760E−09 |

EC50 data for binding to mouse ICOS are shown in Table E4-2 below and in FIG. 5 (B).

TABLE E4-2

| mICOS Best-Fit values | N = 1 EC50 (M) | N = 2 EC50 (M) | N = 3 EC50 (M) | Mean (M) | STDEV (M) | SEM (M) |
|---|---|---|---|---|---|---|
| STIM003_457 | 8.923E−09 | 1.099E−08 | 1.187E−08 | 1.059E−08 | 1.514E−09 | 8.741E−10 |
| STIM001_457 | 5.138E−09 | 3.530E−09 | 6.974E−09 | 5.214E−09 | 1.724E−09 | 9.951E−10 |
| STIM003 | 6.803E−09 | 2.195E−09 | 7.275E−09 | 5.424E−09 | 2.807E−09 | 1.620E−09 |
| STIM001 | 2.567E−08 | 5.063E−09 | 2.008E−08 | 1.694E−08 | 1.066E−08 | 6.152E−09 |

Also as expected, monospecific antibodies STIM001, STIM003 and control IgG1 did not show binding to human PD-L1 with either anti-human IgG detection or human ICOS labelled AlexaFluor 647.

CHO Mouse PD-L1 Binding Assay (Flow Cytometry)

Ability of the ICOS/PD-L1 mAb$^2$ to bind mouse PD-L1 on the surface of CHO cells was confirmed in this assay. Binding of the bispecific antibody to PD-L1 could be detected using ICOS, confirming the ability of the bispecific antibodies to bind both PD-L1 and ICOS.

STIM001_457 and STIM003_457 and one isotype control (IgG1_438) were assessed for human PD-L1 binding using FACS. These were characterised using anti-human IgG and human ICOS labelled AlexaFluor 647 detection.

Method:

CHO-S cells untransfected (referred to as WT) or transfected with mPD-L1 were diluted in FACS buffer (PBS+1% w/v BSA+0.1% w/v sodium azide) and were distributed to a 96-well V-bottom plate (Greiner) at a density of 5×10$^4$ cells per well. Monospecific mAb and bispecific mAb$^2$ titrations were prepared from 22 nM working concentration as a 1/3 dilution series in FACS buffer. Plates were centrifuged at 300×g for 3 minutes to supernatant aspirated. 50 µL antibody or mAb$^2$ solution were added to cells and incubated at 4° C. for 1 hour. Cells were washed with 150 µL of PBS and centrifuged at 300 g for 3 minutes. Supernatant was aspirated and 150 µL PBS added. This wash step was repeated. Presence of bound mAb or mAb$^2$ was detected by addition of 50 µL of Anti-Human IgG PE (Jackson ImmunoResearch) diluted 1/500 in FACS buffer or human ICOS labelled AlexaFluor 647 diluted to 25 nM to each well. Cells were incubated for 1 hour at 4° C. in the dark. Cells were washed as previously described. To fix cells, 100 µL 4% v/v paraformaldehyde was added and cells incubated for 20 minutes at 4° C., cells were pelleted by centrifugation at 300×g and the plates resuspended in 100 µL FACS buffer. AlexaFluor 647 and PE (R-Phycoerythrin) signal intensity (geometric mean) was measured by flow cytometry using a Beckman Coulter CytoFLEX instrument.

Results:

Bispecific antibodies and isotype control produced similar EC50 values to each other in the anti-human IgG detection system (0.89±0.64 nM, 0.47±0.23 nM and 0.59±0.20 nM respectively)—FIG. 7 (A)—and in the human ICOS labelled AlexaFluor 647 system (1.29±1.26 nM and 0.81±0.56 nM respectively)—FIG. 7 (B). The isotype control did show binding.

Monospecific antibodies STIM001, STIM003 and IgG1 did not show binding to human PD-L1 with either anti-human IgG detection or human ICOS labelled AlexaFluor 647.

Example 5a Biolayer Interferometry Determination of mAb2 Binding to Fcγ Receptors Materials:

Sensors coated with a commercial anti-human FAb-CH1 ligand (Pall ForteBio, cat No 18-5125) were hydrated for 10 min in running buffer (1×HBS-EP+ Buffer: Technova, cat. No. H8022).

The mAb$^2$_289 constructs STIM001_289 and STIM003_289 were diluted to 45 µg/mL in running buffer.

The recombinant human FcγRI (1257-FC-050, R&D Systems), mouse FcγRI (2074-FC-050, R&D Systems) and mouse FcγRIV (1974-CD-050, R&D Systems) were diluted to 1 µM in running buffer. The recombinant human FcγRIIIa (4325-FC-050, R&D Systems) and mouse FcγRIII (1960-FC-050, R&D Systems) were diluted to 2 µM in running buffer. Finally, the recombinant human FcγRIIa (1330-CD-050, R&D Systems), human FcγRIIb/c (1875-CD-050, R&D Systems) and mouse FcγRIIb (1460-CD-050, R&D Systems) were diluted to 3 µM in running buffer.

The human recombinant extracellular domain PD-L1 protein was diluted to 1 µM in running buffer.

Method:

The anti-human FAb-CH1 sensors were regenerated with 100 mM PO$_4$ then equilibrated in running buffer. STIM001_289 and STIM003_289 were captured at 45 µg/mL on the sensors and then loaded with 1 µM of human PD-L1. Finally, the sensors were dipped into the Fcγ receptor solution. The sensors were then regenerated and equilibrated again, and the same protocol was repeated for each Fcγ receptor. The assay was carried out at 25° C.

Results:

| Fc gamma Receptor | STIM001_289 | STIM003_289 |
| --- | --- | --- |
| Human FcγR I | Binding | Binding |
| Human FcγR IIa | Binding | Binding |
| Human FcγR IIb/c | Binding | Binding |
| Human FcγR IIIa | Binding | Binding |
| Mouse FcγR I | Binding | Binding |
| Mouse FcγR IIb | Binding | Binding |
| Mouse FcγR III | Binding | Binding |
| Mouse FcγR IV | Binding | Binding |

In this assay, both mAb$^2$_289 constructs (STIM001_289 and STIM003_289) demonstrated expected binding to all the individual Fcγ receptors.

Example 5b Engagement of Fc Receptor on ADCC Effector Cells by Fc Region of Bispecific Antibody to ICOS and PD-L1

This assay determines ability of the Fc region of mAb$^2$ to engage FcγRIIIa on effector cells.

Method:

Immediately prior to the assay CHO (target) cells expressing human ICOS or mouse ICOS were centrifuged and resuspended in RPMI 1640 (Promega)+4% Low IgG serum (Promega) and plated at 50000 cells/well (25 µl/well) in 96-well white bottom TC-treated plates (Costar).

All antibodies were serially diluted 1 in 3 over 9 points, in RPMI 1640+4% Low IgG serum. For assays with human ICOS expressing target cells, the antibodies were diluted from starting working concentration of 10 nM and for mouse ICOS expressing target cells the mAb$^2$ and mAb were diluted from a starting working concentration of 20 nM and 35 nM, respectively. Diluted antibodies (25 µl/well) were added to the target cells and left to incubate for 0.5 hrs at room temperature. Thawed Jurkat NFAT luciferase v-variant effector cells (Promega) were resuspended in RPMI 1640+ 4% low IgG serum and added to the target cell/antibody mixture at 10000 cells/well (25 µl/well). After overnight incubation at 37° C., 5% CO2, luciferase activity was measured by adding luminogenic BioGlo substrate at 75 µl/well (Promega) directly to the wells, plates incubated for 10 min in the dark and read on an Envision (Perkin Elmer) plate reader.

Relative light unit (RLU) values from the raw data (Envision reads) were first normalised to 'fold of induction' using the following equation.

$$\text{Fold of induction} = \frac{RLU\ (\text{induced}) - RLU\ (\text{background})}{RLU\ (\text{background})}$$

Mean and standard deviation 'fold of induction' values for each antibody concentration were plotted and curves were fitted using the GraphPad Prism 4-parameter log-logistic curve. The average 'fold of induction' values for each experiment were then used to plot the inter-experimental values (+/−SD) from all three experiments.

Results:

Data are summarised in Table E5-1 and in FIGS. 8 A and B. STIM003_289 and STIM001_289 produced similar EC50 values in the human and mouse ICOS ADCC assay.

TABLE E5-1

| hICOS Best-Fit value | N = 1 EC50 (M) | N = 2 EC50 (M) | N = 3 EC50 (M) | Mean (M) | STDEV (M) | SEM (M) |
|---|---|---|---|---|---|---|
| STIM003_289 | 2.309E−10 | 4.009E−10 | 2.069E−10 | 2.796E−10 | 1.058E−10 | 6.108E−11 |
| STIM001_289 | 1.419E−09 | 4.019E−10 | 2.493E−10 | 6.900E−10 | 6.358E−10 | 3.671E−10 |
| STIM003 | 3.258E−10 | 4.769E−10 | 2.397E−10 | 3.474E−10 | 1.201E−10 | 6.933E−11 |
| STIM001 | 4.559E−10 | 2.467E−10 | 1.467E−10 | 2.831E−10 | 1.578E−10 | 9.112E−11 |

| mICOS Best-Fit values | N = 1 EC50 (M) | N = 2 EC50 (M) | N = 3 EC50 (M) | Mean (M) | STDEV (M) | SEM (M) |
|---|---|---|---|---|---|---|
| STIM003_457 | 7.702E−10 | 1.353E−09 | 1.894E−09 | 1.339E−09 | 5.621E−10 | 3.245E−10 |
| STIM001_457 | 8.627E−10 | 4.888E−09* | 1.077E−08* | 8.627E−10 | | |
| STIM003 | 5.079E−10 | 7.544E−10 | 7.025E−10 | 6.549E−10 | 1.299E−10 | 7.502E−11 |
| STIM001 | 4.790E−10 | 5.337E−10 | 5.786E−10 | 5.304E−10 | 4.988E−11 | 2.880E−11 |

*EC50 values excluded due to incomplete curve fit.

Example 5c ADCC Assay Using Peripheral Blood Mononuclear Cells (PBMC)

The potential to kill via ADCC ("antibody-dependent cell-mediated cytotoxicity") of STIM001_289 and STIM003_289 was compared with that of STIM001 and STIM003 in the Delfia BATDA cytotoxicity assay (Perkin Elmer) using human primary NK cells as effector and ICOS-transfected CCRF-CEM cells as target cells. This method is based on loading target cells with an acetoxymethyl ester of fluorescence enhancing ligand (BATDA) which quickly penetrates the cell membrane. Within the cell the ester bonds are hydrolysed to form a hydrophilic ligand (TDA) which no longer passes the membrane. After cytolysis, the ligand is released and can be detected by addition of Europium which forms with the TDA a highly fluorescent and stable chelate (EuTDA). The measured signal correlates directly with the amount of lysed cells.

Isolation of Mononuclear Cells from Human Peripheral Blood:

Leukocyte cones were collected from healthy donors and their content was diluted up to 50 ml with phosphate buffered saline (PBS, from Gibco) and layered into 2 centrifuge tubes on top of 15 mL Ficoll-Paque (from GE Healthcare). PBMC were separated by density gradient centrifugation (400 g for 40 min without brake), transfer in a clean centrifuge tube and then wash with 50 mL PBS, twice by centrifuging at 300 g for 5 min and twice by centrifuging at 200 g for 5 min. PBMC were then resuspended in R10 media (RPMI+10% heat-inactivated Fetal Bovine Serum, both from Gibco) and their cell count and viability assess with EVE™ Automated Cell Counter (from NanoEnTek).

ADCC Assay Methods:

Labelling of target cells was performed according to manufacturer's instruction. Briefly, CCRF-CEM cells were resuspended at 1×10⁶/mL in assay media (RPMI+10% ultra-low IgG FBS, from Gibco) and loaded with 5 µl/mL of Delfia BATDA reagent (Perkin Elmer) for 30 min at 37° C. Cells were then washed 3 times with 50 mL PBS (300 g for 5 min) and resuspended at $8\times10^5$/ml (3×) in assay media.

STIM001_289, STIM003_289, STIM001, STIM003 and their isotype controls, IgG1_289 and IgG1 were serially diluted 1:4 in assay media to give final 3× antibody concentrations ranging from 30 nM to 0.12 µM (10-point curve).

NK cells were negatively isolated from PBMC using the EasySep Human NK Cell Isolation Kit (from Stemcell Technologies) and resuspended at $4\times10^6$/ml (3×) in assay media.

BATDA-loaded CCRF-CEM and primary NK cells were co-cultured for 4-hours at 37° C. and 5% CO2 at a 5:1 Effector:Target ratio in assay media in the presence of the antibodies under investigation (from 10 nM to 0.04 µM final concentration). Wells containing CCRF-CEM cells only or CCRF-CEM+Delfia lysis buffer (Perkin Elmer) were used to determine spontaneous and 100% BATDA release, respectively. Cell-free supernatants were then transferred into a DELFIA Microtitration Plates and incubated for 15 min at Room Temperature with the Delfia Europium solution (Perkin Elmer). Fluorescent signal at 615 nM was then quantified with Envision Multilabel Reader (Perkin Elmer).

Specific dye release induced by the Abs was calculated as: [(Experimental release−Spontaneous release)/(Maximum release−Spontaneous release)]*100.

This experiment was repeated with NK-cells from 2 independent donors and 3 technical replicates were included for each assay condition.

Figure 9:
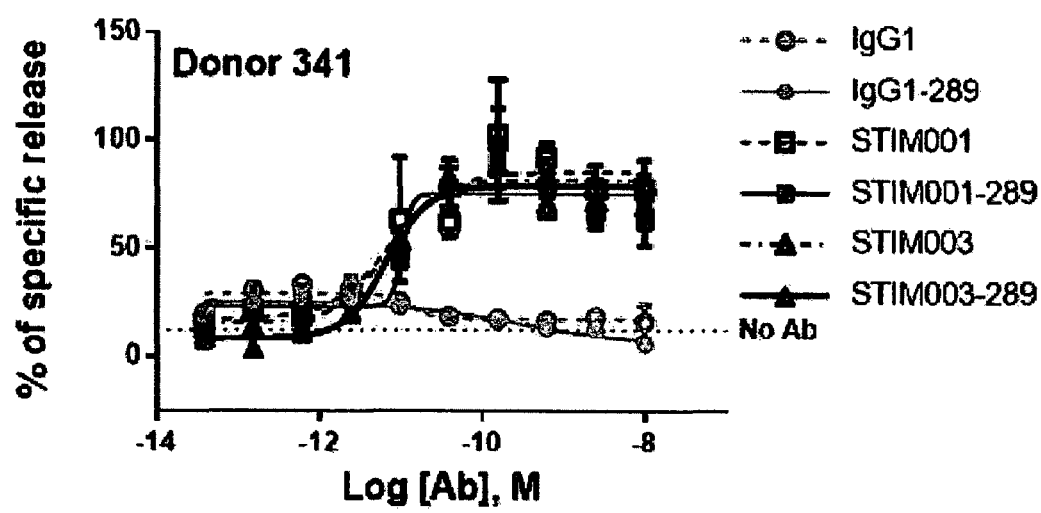
FIG. 9 Concentration-dependent study of STIM001_289 and STIM003_289 mediated ADCC on ICOS-transfected CCRF-CEM cells using freshly isolated NK cells as effector cells for 3 independent donors (panels A, B and C), as described in Example 5c. The effector cells and target cells (effector:target ratio of 5:1) were incubated together with antibody for 4 hours. Dye release from lysed target cells was measured as described in the kit manufacturer's instructions. Lysis buffer was used to determine the 100% release. Basal killing (no Ab) is indicated by a dotted line at the bottom of each graph.

Results:

The ability of STIM001_289 and STIM003_289 bispecific antibodies to induce ADCC was assessed using primary NK cells from 3 independent donors, as effector cells and ICOS-transfected CCRF-CEM as target cells. STIM001 and STIM003 and the relevant isotype controls (IgG1 and IgG1_289) were run in the same experiments. Target cells were loaded with BADTA dye and incubated for 4 hrs either alone (spontaneous release), with lysis buffer (100% release)

or with NK cells plus increasing concentration of antibody. Dye release correlates directly with the number of lysed cells. Data are showed as % of specific dye release and plotted against the log of antibody concentrations (FIG. 9). In all donors, STIM001_289, STIM003_289, STIM001 and STIM003 increased the % of specific dye release in a concentration dependent manner. Non-linear regression curves (variable slope, 4-parameter) were extrapolated from the data obtained. These data demonstrate that the bispecific constructs have the ability to kill ICOS positive cells in a primary NK dependent ADCC assay. The EC50s of the bispecific antibodies in the ADCC assay were comparable to those of STIM001 and STIM003 monoclonal IgG1 antibodies. See Table E5-2 and FIG. 9 A-C.

TABLE E5-2

EC50 (pM) of STIM001_289 and STIM003_289 antibodies in the ADCC assay using ICOS-transfected CCRF-CEM cells and freshly isolated NK cells as effector cells (non-linear fit, 4-parameters, n = 2).

| EC50 (pM) | Donor 326 | Donor 334 | Donor 341 | Median | SD |
|---|---|---|---|---|---|
| STIM001 | 42.6 | 20.5 | 7.6 | 23.6 | 17.7 |
| STIM001_289 | 30.9 | 4.1 | ~10.3 | 17.5 | 19.0 |
| STIM003 | 21.2 | 3.7 | 6.7 | 10.5 | 9.4 |
| STIM003_289 | 11.1 | 18.3 | 6.6 | 12.0 | 5.9 |

Example 6 Ability of ICOS/PD-L1 Bispecific Antibody to Neutralise ICOS Binding to ICOS Ligand Anti-ICOS antibodies in monoclonal and mAb² format were assessed for ICOS ligand (B7-H2) neutralisation using HTRF. These antibodies are capable of neutralising both human and mouse ICOS B7-H2 ligand and were assessed in both Human ICOS Receptor/Human Ligand and Mouse ICOS Receptor/Mouse Ligand HTRF based Neutralisation assays.

Method:

Antibodies were diluted in assay buffer (0.53M Potassium Fluoride (KF), 0.1% Bovine Serum Albumin (BSA) in 1×PBS) from a starting working concentration of either 1 µM or 0.4 µM and serially diluted 1 in 3 over 11 points. 5 µl of titrated antibody were added to 384w solid white assay plate (Greiner Bio-One). Positive and negative control wells received 5 µl of assay buffer only.

5 µl of human ICOS-mFc (Chimerigen) at 20 nM (5 nM final) or 5 ul of mouse ICOS-mFc (Chimerigen) at 4 nM (1 nM final) were added to relevant assay wells. Plate was incubated for 1 hour (hr) at room temperature (RT).

After incubation, 5 µl of ICOS ligand, (B7-H2, R&D Systems) conjugated to Alexa 647 (Innova Bioscience) was diluted to either 14.08 nM (3.52 nM final) for human B7-H2 or 36.08 nM (9.02 nM final) for mouse B7-H2 and added to all wells of assay plate except negative control wells which instead received 5 ul of assay buffer.

Finally, 5 µl of 4.32 nM anti-mouse IgG donor mAb (Southern Biotech) labelled with europium cryptate (Cis Bio), was added to each well and the assay was left in the dark at RT to incubate for a further 2 hours. After incubation, assay was read on Envision plate reader (Perkin Elmer) using a standard HTRF protocol. 620 nm and 665 nm channel values were exported to Microsoft Excel and % Delta-F and % Neutralisation calculations performed. Titration curves and IC50 values [M] were plotted using Graphpad (Prism). IC50 values were calculated by first transforming the data using equation X=Log(X). The transformed data was then fitted using nonlinear regression, using fitting algorithm, log (inhibitor) vs. response-variable slope (four parameters).

% Delta-F Calculation

665/620 nm ratio for ratio metric data reduction.

$$\% \text{ Delta } F = \frac{(665/620 \text{ nm Well Signal Ratio} - \text{Signal Negative Control})}{(\text{Signal Negative Control})} * 100$$

Signal Negative control = average of minimum signal ratio.

% Neutralisation $$\% \text{ Max (neutralisation)} = \frac{(\% \text{ Delta-F of sample well} - \text{Negative Control})}{(\text{Positive Control} - \text{Negative Control})} * 100$$

Results:

In the human ICOS ligand neutralisation system, STIM003_289 and STIM003_457 produced similar IC50 values to STIM003 (mean IC50 values, 0.81±0.28 nM, 0.56±0.18 nM and 0.53±0.15 nM respectively).

In the human ICOS ligand neutralisation system, STIM001_289 and STIM001_457 produced similar IC50 values to STIM001 (mean IC50 values, 2.0±1.7 nM, 1.6±6.9 nM and 1.5±0.75 nM respectively).

In the mouse ICOS ligand neutralisation system, STIM003_289 and STIM003_457 produced similar IC50 values to STIM003 (mean IC50 values, 0.14±0.037 nM, 0.11±0.027 nM and 0.12±0.027 nM and respectively).

In the mouse ICOS ligand neutralisation system, STIM001_289 and STIM001_457 produced similar IC50 values to STIM001 (mean IC50 values, 4.8±1.7 nM, 5.16±1.5 nM and 8.7±6.6 nM and respectively).

In the human ICOS ligand neutralisation system, STIM003 produced similar IC50 values to STIM001 (mean IC50 values, 0.53±0.15 nM, 1.5±0.75 nM respectively).

In the mouse ICOS ligand neutralisation system, STIM003 produced more potent IC50 values to STIM001 (mean IC50 values, 0.12±0.027 nM and 8.7±0.66 nM respectively).

Data are summarised in Table E6-1 and Table E6-2 and FIGS. 10 A and B.

TABLE E6-1

| Ab | IC50 Human ICOS Receptor/ Human H7-H2 | | | Average | SD |
|---|---|---|---|---|---|
| | n1 (nM) | n2 (nM) | n3 (nM) | IC50 (nM) | (nM) |
| STIM003_289 | 0.58 | 0.73 | 1.11 | 0.81 | 0.27 |
| STIM001_289 | 1.00 | 0.94 | 3.95 | 1.96 | 1.72 |
| STIM003_457 | 0.44 | 0.47 | 0.77 | 0.56 | 0.18 |
| STIM001_457 | 1.10 | 1.32 | 2.38 | 1.60 | 0.68 |
| STIM003 | 0.43 | 0.45 | 0.71 | 0.53 | 0.16 |
| STIM001 | 0.96 | 1.12 | 2.33 | 1.47 | 0.75 |

TABLE E6-2

| Patent Ab | IC50 Mouse ICOS Receptor/ Mouse B7-H2 | | | Average | SD |
|---|---|---|---|---|---|
| | n1 (nM) | n2 (nM) | n3 (nM) | IC50 (nM) | (nM) |
| STIM003_289 | 0.10 | 0.17 | 0.13 | 0.13 | 0.04 |
| STIM001_289 | 3.25 | 6.53 | 4.57 | 4.78 | 1.65 |
| STIM003_457 | 0.087 | 0.13 | 0.10 | 0.11 | 0.02 |
| STIM001_457 | 3.39 | 5.49 | 6.32 | 5.07 | 1.51 |
| STIM003 | 0.87 | 0.14 | 0.11 | 0.37 | 0.43 |
| STIM001 | 7.98 | 8.91 | 9.25 | 8.71 | 0.66 |

Example 7 Ability of ICOS/PD-L1 Bispecific Antibody to Neutralise PD-L1 Binding to PD1 or CD80

Neutralisation of Human PD-L1 Binding

Bispecific mAb$^2$ antibodies STIM001_289 and STIM003_289, two anti-PD-L1 antibodies AbW and AbV, and one isotype control (IgG1_289), were assessed for ability to neutralise human PD-L1 binding to its receptors human PD1 and human CD80 on CHO cells, using flow cytometry (FACS). Ability of the mAb$^2$ to neutralise binding of human PD-L1 to its receptors was confirmed in this assay.

Method:

CHO-S cells untransfected (referred to as WT) or transfected with human PD-L1 were diluted in FACS buffer (PBS+1% w/v BSA+0.1% w/v sodium azide) and were distributed to a 96-well V-bottom plate (Greiner) at a density of 5×10$^4$ cells per well. Biotinylated human CD80-Fc (R&D Systems) or PD-1-Fc were prepared as a standard curve titration from 1 µM final assay concentration (FAC), 1/3 dilution series in FACS buffer. Antibody and mAb$^2$ titrations were prepared from 396 nM working concentration, 198 nM FAC, as a 1/3 dilution series in FACS buffer. Biotinylated PD-1 or CD80 were diluted in FACS buffer to 80 nM working concentration, 40 nM FAC. Plates were centrifuged at 300×g for 3 minutes to supernatant aspirated. 25 µL receptor and 25 µL mAb$^2$ solution (or 50 µL of receptor standard curve titration) were added to cells and incubated at 4° C. for 1 hour. Cells were washed with 150 µL of PBS and centrifuged at 300 g for 3 minutes. Supernatant was aspirated and 150 µL PBS added. This wash step was repeated. Presence of bound CD80 or PD-1 was detected by addition of 50 µL of streptavidin-AlexaFluor 647 (Jackson ImmunoResearch) diluted 1/500 in FACS buffer to each well. Cells were incubated 1 hr at 4° C. in the dark. Cells were washed as previously described. To fix cells, 100 µL 4% v/v paraformaldehyde was added and cells incubated for 20 minutes at 4° C., cells were pelleted by centrifugation at 300×g and the plates resuspended in 100 µL FACS buffer. AlexaFluor 647 signal intensity (geometric mean) was measured by flow cytometry using a Beckman Coulter Cyto-FLEX.

Percentage of receptor binding (flow cytometry):

Based on geometric mean fluorescence

Equation X $$\% \text{ of specific binding} = \frac{\text{sample value} - \text{non-specific binding}}{\text{total binding} - \text{non-specific binding}} \times 100$$

Total binding = biotinylated PD-1 or CD80 only (Isotype antibody at 198 nM)

Non-specific binding = mAb$^2$ at concentration of 198 nM

Results:

Data are shown in Tables E7-1 and E7-2 below and in FIGS. 11 A and B.

TABLE E7-1

IC50 (nM) values for human PD1/PD-L1 neutralisation, detected with streptavidin-AlexaFluor 647. Not calculated: Ab was used in assay with no complete IC50 curve being calculable. See FIG. 11 A.

| | IC50 Human PD1/PD-L1 Neutralisation (nM) |
|---|---|
| STIM003 | Not Calculated |
| STIM003_289 | 0.28 |
| AbW | 0.70 |
| STIM001 | Not Calculated |
| STIM001_289 | 0.47 |
| AbV | 0.86 |
| IgG1 | Not Calculated |
| IgG1_289 | 0.34 |

TABLE E7-2

IC50 (nM) values for human CD80/PD-L1 neutralisation, detected with streptavidin-AlexaFluor 647. Not calculated: Ab was used in assay with no complete IC50 curve being calculable. See FIG. 11 B.

| | IC50 Human CD80/PD-L1 Neutralisation (nM) |
|---|---|
| STIM003 | Not Calculated |
| STIM003_289 | 0.26 |
| AbW | 0.74 |
| STIM001 | Not Calculated |
| STIM001_289 | 0.43 |
| AbV | 0.85 |
| IgG1 | Not Calculated |
| IgG1_289 | 0.21 |

Neutralisation of Mouse PD-L1 Binding

Ability of the ICOS/PD-L1 bispecific antibody to neutralise binding of mouse PD-L1 to its receptors was confirmed in this assay.

Method:

CHO-S cells untransfected (referred to as WT) or transfected with mouse PD-L1 were diluted in FACS buffer (PBS+1% w/v BSA+0.1% w/v sodium azide) and were distributed to a 96-well V-bottom plate (Greiner) at a density of 5×104 cells per well. Biotinylated mouse PD-1-Fc (R&D Systems) or CD80-Fc (R&D Systems) were prepared as a standard curve titration from 1 µM final assay concentration (FAC), 1/3 dilution series in FACS buffer. Antibody and mAb$^2$ titrations were prepared from 44 nM working concentration, 22 nM FAC, as a 1/3 dilution series in FACS buffer. Biotinylated PD-1 or CD80 were diluted in FACS buffer to 80 nM working concentration, 40 nM FAC. Plates were centrifuged at 300×g for 3 minutes to supernatant aspirated. 25 µL receptor and 25 µL mAb² solution (or 50 µL of receptor standard curve titration) were added to cells and incubated at 4° C. for 1 hour. Cells were washed with 150 µL of PBS and centrifuged at 300 g for 3 minutes. Supernatant was aspirated and 150 µL PBS added. This wash step was repeated. Presence of bound CD80 or PD-1 was detected by addition of 50 µL of streptavidin-AlexaFluor 647 (Jackson ImmunoResearch) diluted 1/500 in FACS buffer to each well. Cells were incubated 1 hr at 4° C. in the dark. Cells were washed as previously described. To fix cells, 100 µL 4% v/v paraformaldehyde was added and cells incubated for 20 minutes at 4° C., cells were pelleted by centrifugation at 300×g and the plates resuspended in 100 µL FACS buffer. AlexaFluor 647 signal intensity (geometric mean) was measured by flow cytometry using a Beckman Coulter CytoFLEX.

Percentage of receptor binding (flow cytometry)

Based on geometric mean fluorescence

Equation X $$\% \text{ of specific binding} = \frac{\text{sample value} - \text{non-specific binding}}{\text{total binding} - \text{non-specific binding}} \times 100$$

Total binding = biotinylated *PD*-1 or *CD*80 only (Isotype antibody at 22 nM *FAC*)

Non-specific binding = $mAb^2$ at concentration of 22 nM *FAC*

Results:

The bispecific mAb²s and an isotype control antibody IgG1_438 were assessed for ability to neutralise binding of mouse PD-L1 to its receptors mouse PD1 and mouse CD80 using FACS. Results are shown in Table E7-3, Table E7-4 and FIG. 12.

STIM001_457, STIM003_457 and IgG1_438 produced similar 1050s (0.35±0.09 nM, 0.40±0.13 nM, and 0.34±0.05 nM respectively) using the PD-L1 and PD1 neutralising system. These mAb²s also neutralised PD-L1 binding to CD80 (IC50, 0.9±0.03 nM, 0.29±0.0002 nM and 0.27±0.06 nM respectively).

Monoclonal antibodies STIM001, STIM003 and IgG1 control did not neutralise mouse PD-L1 binding to mouse PD1 or mouse CD80.

Example 8 Effect of ICOS/PD-L1 Bispecific Antibody on T Cells in ICOS-Dependent Activation Assay The agonistic potentials of STIM001_289 and STIM003_289 bispecific antibodies in this assay were compared with those of STIM001 and STIM003 monoclonal antibodies in a human primary T-cell activation assay where anti-CD3 and anti-CD28 antibodies were added concurrently to induce ICOS expression on effector T-cells. Effect of the ICOS co-stimulation on the level of IFN-γ produced by these activated T-cells were assessed using ELISA at 72 hrs post-activation. This assay is used to confirm activity of the ICOS-binding portion of the bispecific antibody. Retention of ability to induce ICOS-mediated T cell activation was confirmed for anti-ICOS antibodies STIM001 and STIM003 in the ICOS/PD-L1 mAb² bispecific format in which the Fcab region binds human PD-L1.

Methods:

PBMC were isolated from human peripheral blood as described in Example 5c and stored in nitrogen for further utilisation.

STIM001_289, STIM003_289, STIM001, STIM003 and their isotype controls, IgG1_289 and IgG1 were serially diluted 1:3 in PBS to give final antibody concentrations ranging from 10 µM to 40 nM (6-point curve). 100 µL of diluted antibodies were coated in duplicate into a 96-well, high-binding, flat-bottom plate (Corning EIA/RIA plate) overnight at 4° C. Plate was then washed with PBS. In some experiments an anti-PD-L1 antibody, AbV, was added at the same concentrations.

T-cells were negatively isolated from frozen PBMC using the EasySep Human T Cell Isolation Kit (from Stemcell Technologies) and resuspended at 2×10⁶/ml in R10 media supplemented with 40 µl/ml of Dynabeads Human T-Activator CD3/CD28 (from Life Technologies).

T-cell suspensions were added to antibody-coated plates to give a final cell concentration of 1×10⁶ cells/ml and cultured for 72 hrs at 37° C. and 5% CO2. Cell free supernatants were then collected and kept at minus 20° C. until analysis of secreted IFN-γ by ELISA with the R&D Systems™ Human IFNγ Duoset® ELISA, using DELFIA® Eu-N1 Streptavidin detection.

This experiment was repeated on T-cells isolated from 4 independent donors and 2 technical replicates were included for each assay condition.

Figure 13:
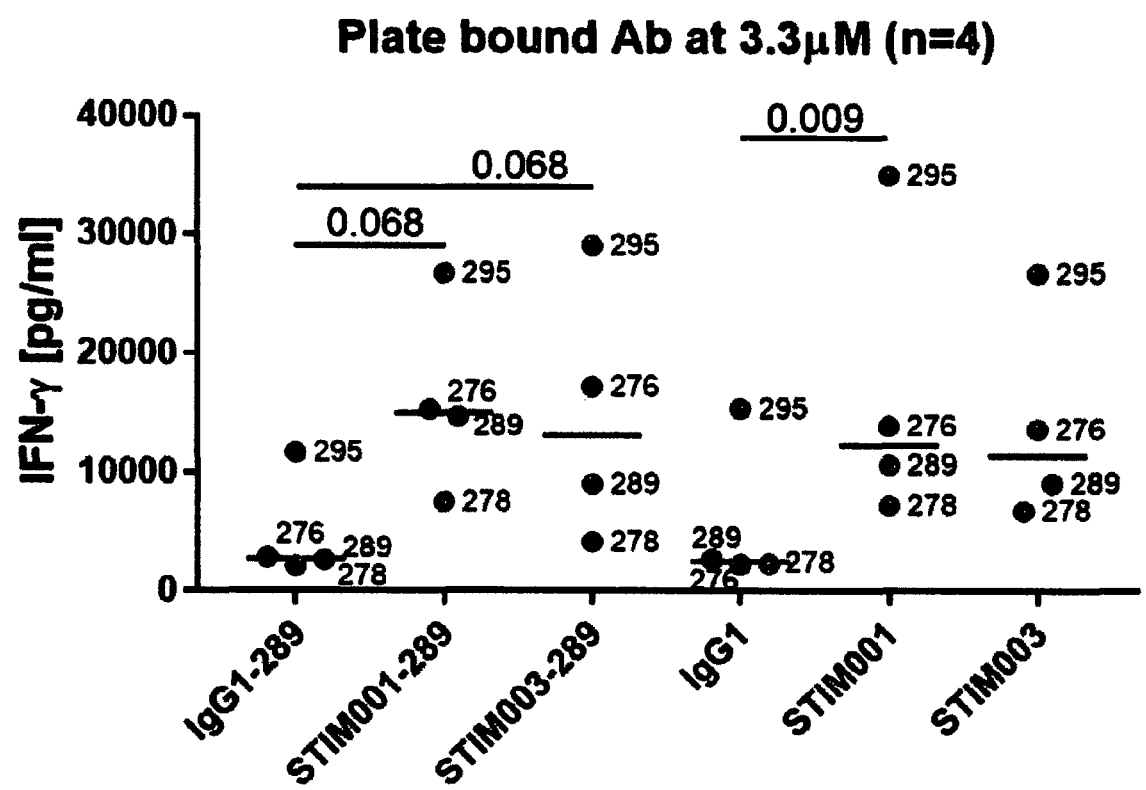
FIG. 13 Concentration-dependent study of STIM001_289 and STIM003_289 vs STIM001 and STIM003 agonist effect on isolated human T-cells co-stimulated with CD3/CD28 dynabeads for 3-days. IFN-γ production was used as a read-out of ICOS agonism. All antibodies were tested plate-bound and compared to their isotype controls. Mean±SD values of technical replicates as well as non-linear regression curves (variable slope, 4-parameter) are shown for 1 donor (278) in the panels A and B. In panel C is shown an example set of data comparing the levels of IFN-γ (mean value) induced at one given dose (3.3 µM) for all 4 donors. Each dot represents an independent donor identifiable by its number and the median of 4 donors is marked by a line. Significance was assessed using Friedman statistic test and p-values are indicated on the graph.

Results:

The levels of IFN-γ induced by STIM001_289, STIM003_289, STIM001, STIM003 and their isotype controls (IgG1_289 and IgG1) were measured in assay replicates and plotted as mean value±Standard Deviation (SD) against the log of antibody concentrations, as showed for one donor (FIGS. 13, A and B). All antibodies increased the levels of IFN-γ in a concentration dependent manner. In some experiments, anti-PD-L1 AbV was added as the same concentration and did not modify the levels of IFN-γ. Non-linear regression curves (variable slope, 4-parameter) were extrapolated from data obtained with 4 independent donors (EC50 values in Table E8). Both STIM001_289 and STIM003_289 increased the IFN-γ levels to the same extent as STIM001 and STIM003 respectively. Both EC50 values (Table E8) and levels of IFN-γ at the plateau (3.3 µM, FIG. 13 C) were comparable for STIM001 vs STIM001_289 and for STIM003 vs STIM003_289 (median values). These data demonstrate that the ICOS binding sites of the anti-ICOS monoclonal antibodies have conserved their ICOS agonistic effect on human primary T-cells when included in the ICOS/PD-L1 bispecific antibodies.

TABLE E8

| EC50 (nM) | T-cells from donors | | | | Median | SD |
|---|---|---|---|---|---|---|
| | 278 | 276 | 289 | 295 | | |
| STIM001 | ~10.2 | ~9.9 | ~11.2 | 14.5 | 10.7 | 2.11 |
| STIM001-289 | 8.9 | ~10 | 7.1 | 11.9 | 9.45 | 2.01 |
| STIM003 | 3.8 | 7.1 | ~4 | ~11.6 | 5.55 | 3.64 |
| STIM003-289 | ~3.8 | ~6.0 | 10.2 | 12.7 | 8.1 | 4.02 |

~value corresponding to the best fit found by GraphPad Prism
Concentration response curves of IFN-γ following antibody treatments (non-linear fit, 4-parameters, n = 4).

Example 9 Effect of ICOS/PD-L1 Bispecific Antibody on T Cell Activation in Monocyte Co-Culture Primary Cell Assay This assay can be used to assess ability of the PD-L1 binding site of the bispecific antibody to block PD-L1 PD1 interaction and thereby promote activation of T cells in autologous co-culture of T and B lymphocytes from peripheral blood samples. The effects of STIM001_289, STIM003_289 and IgG1_289 mAb$^2$ antibodies on IFN-γ production were compared to those of anti-PD-L1 AbV, STIM003 and IgG1 monoclonal antibodies in a co-culture of purified peripheral blood monocytes and CD45RO+ memory T-cells from the same donor. These cultures were done in the presence of anti-CD3 antibody to provide TCR stimulation. Retention of ability to promote T cell activation in this assay was confirmed for STIM001 and STIM003 in the ICOS/PD-L1 mAb$^2$ bispecific format in which the Fcab region binds human PD-L1. The control PD-L1 mAb$^2$, lacking an ICOS binding site, was inactive in this assay.

Methods:

PBMC were isolated from human peripheral blood as described in Example 5c and stored in nitrogen for further utilisation.

STIM001_289, STIM003_289, IgG1_289, anti-PD-L1 AbV, STIM003 and their isotype control IgG1 were serially diluted 1:4 in R10 media to give final 4× antibody concentrations ranging from 40 nM to 40 µM (6-point curve). Anti-human CD3 (clone UCHT1 from eBioscience) was diluted in R10 media to a 4×Ab concentration of 2 µg/ml.

Monocytes and memory cells were isolated from frozen PBMC from the same donor. Monocytes were negatively isolated using the Pan Human Monocyte Isolation Kit (Miltenyi biotec) and resuspended at 2×10$^6$/ml (4×) in R10 media. CD45RO+ T-cells were isolated by a first round of negative selection for CD3+ T cells (Pan T-cell isolation kit, Miltenyi Biotec), followed by a positive selection for CD45RO+ cells (Human CD45RO MicroBeads, Miltenyi Biotec). CD45RO+ T-cells were then resuspended at 2×10$^6$/ml (4×) in R10 media. Cell subsets were co-cultured for 4-days at 37° C. and 5% CO2 at a 1:1 ratio in R10 media in the presence of anti-CD3 (0.5 µg/ml final concentration) and the antibodies under investigation (from 10 nM to 10 µM final concentration). In some wells, no antibody under investigation was added to be able to quantify the basal IFN-γ level (Monocytes+T-cells+CD3 only). After 4-days culture, cell-free supernatants were analysed for IFN-γ release with the R&D Systems™ Human IFNγ Duoset® ELISA, using DELFIA® Eu-N1 Streptavidin detection. Fold increase in IFN-γ was calculated as: (Experimental IFN-γ level/Basal IFN-γ level) This experiment was repeated with monocytes and T-cells isolated from 7 independent donors and 3 to 5 technical replicates were included for each assay condition (dependent of the number of cells available).

Results:

The levels of IFN-γ induced by STIM001_289, STIM003_289, IgG1_289, STIM003, PD-L1 AbV and their isotype control (IgG1) were measured in assay replicates and plotted as mean value±standard deviation (SD) against the log of antibody concentrations, as shown for one donor (FIG. 14). Unlike STIM003, the antibodies binding PD-L1 such as STIM001_289, STIM003_289, IgG1_289 and anti-PD-L1 AbV all increased the levels of IFN-γ in a concentration dependent manner. This experiment was repeated in 7 independent donors and high variability in IFN-γ production was noticed in absence of antibody under investigation: 311±177 µg/ml (mean±SD, n=7). Levels of IFN-γ obtained were then normalized by the production of IFN-γ in absence of antibody under investigation. The maximum increase in IFN-γ (values at 10 nM) for all 7 donors was plotted and analysed using Friedman statistic test (FIG. 14). The mean increase in IFN-γ level compared to the isotype control (IgG1) induced by was significant for anti-PD-L1 AbV, STIM003_289 and STIM001_289 and was close to significance for IgG1_289 which also binds to PD-L1. Altogether this data is confirming that the PD-L1 binding sites in the bispecific antibodies retain ability to block PD-1/PD-L1 interaction and can subsequently activate T cells.

Example 10 Anti-Tumour Efficacy of ICOS/PD-L1 Bispecific Antibody on J558 Myeloma In Vivo The J558 syngeneic tumour model was used to assess the effect of bispecific anti-ICOS/anti-PD-L1 antibodies on myeloma. Two ICOS/PD-L1 mAb$^2$ bispecific antibodies, STIM001_457 and STIM003_457, were tested in Balb/c mice using the sub-cutaneous J558 plasmacytoma:myeloma cell line (ATCC, TIB-6), to determine how STIM001_457 hIgG1 and STIM003_457 hIgG1 affect the growth of the tumour.

Method:

Balb/c mice were supplied by Charles River UK at 6-8 weeks of age and >18 g and housed under specific pathogen-free conditions. A total of 5×10$^6$ cells (passage number below P15) were subcutaneously injected (in 100 µl) into the right flanks of mice. Unless stated otherwise, on day 11 post tumour cells injection, the animals were randomised based on tumour size and treatments were initiated. The J558 cells were passaged in vitro by using TrypLE™ Express Enzyme (Thermofisher), washed twice in PBS and resuspended in DMEM supplemented with 10% foetal calf serum. Cell viability was confirmed to be above 90% at the time of tumour cell injection.

Treatment was initiated when the tumours reached an average volume of ~140 mm^3. Animals were then allocated to 3 groups with similar average tumour size (see Table E10-1 below for the dosing groups). Both bispecific antibodies recognise mouse ICOS (Fab portion) and mouse PD-L1 (Fcab portion) and were dosed IP (dosed at 200 ug per dose) from day 11 (post tumour cell implantation) twice a week for 3 weeks unless the animals had to be removed from study due to welfare (rare) or tumour size. As a control, a group of animals (n=10) was dosed at the same time using a saline solution. Tumour growth was monitored over 37 days and compared to tumours of animals treated with saline. Animal weight and tumour volume were measured 3 times per week from the day of tumour cell injection. Tumour volume was calculated by use of the modified ellipsoid formula ½(Length×Width2). Mice were kept on studies until their tumour reached an average diameter of 12 mm3 or, rarely, when incidence of tumour ulceration was observed (welfare).

TABLE E10-1

Treatment groups for the J558 efficacy study.

| Groups | Number of animals | Treatment regimen twice per week from day 11 (Mon/Fri) |
|---|---|---|
| 1 | 10 | Saline |
| 2 | 8 | STIM003_457 200 ug per dose |
| 3 | 8 | STIM001_457 200 ug per dose |

Figure 15:
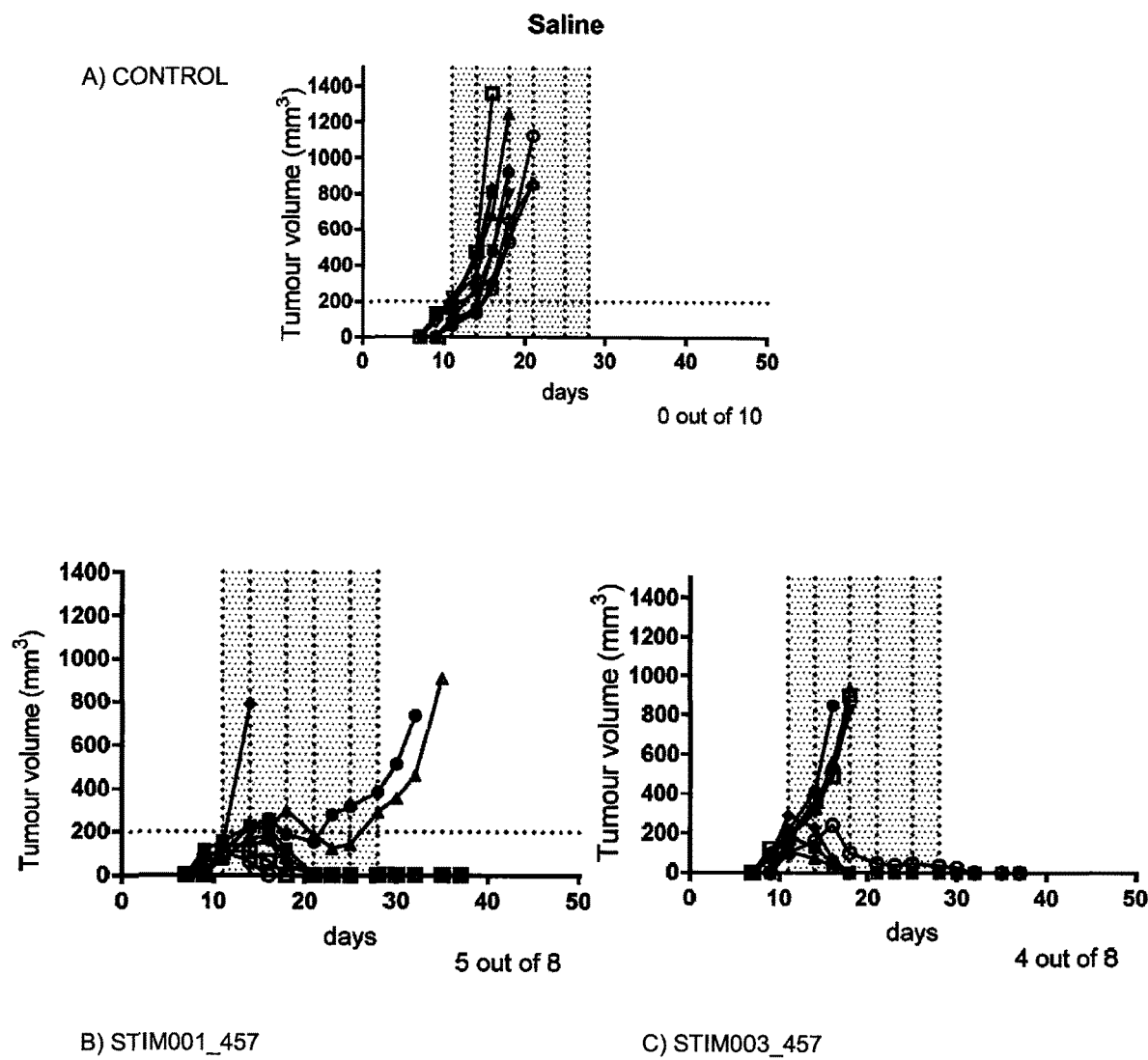
FIG. 15 Effect of STIM001_457 and STIM003_457 bispecific antibodies in the J558 syngeneic tumour study described in Example 10. Each treatment group is represented by a "spider plot" showing the tumour size of individual animals (n=10 or n=8 per group). Both bispecific antibodies demonstrated significant anti-tumour efficacy with 5 out 8 animals treated with STIM001_457 (B) and 4 out of 8 of those treated with STIM003_457 (C) cured from their disease at day 37 compared to the saline treated control group (A) compared to the saline treated control group (A). The number of animals cured of their disease is indicated on the bottom right of the respective graphs. Scheduled dosing days are indicated by dotted lines (day 11, 15, 18, 22, 25 and 29).
Figure 16:
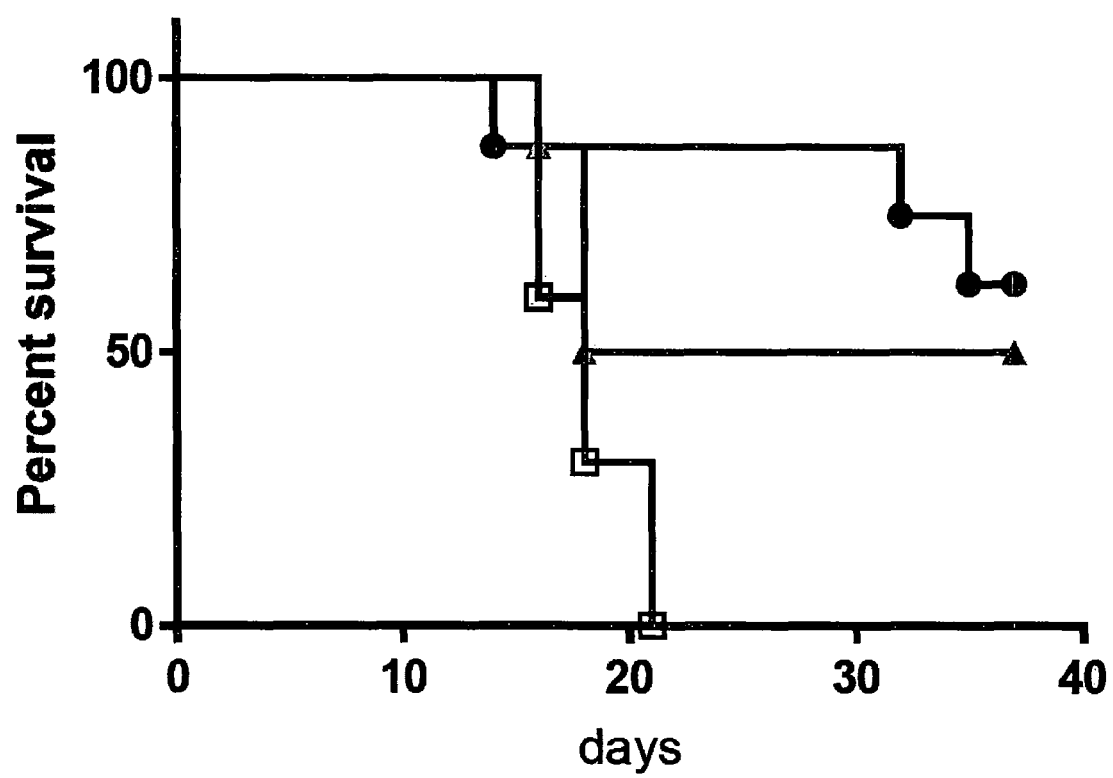
FIG. 16 Kaplan-Meier survival curves/time on study of the % mice surviving after the different treatments described in Example 10. Median survival time of animals on saline (open square) and STIM003_457 (triangle) were 18 and 27.5 days, respectively. Median survival for STIM001_457 (black circle) was not reached.

Results:

The J558 syngeneic model is highly aggressive. All animals in the saline control group (n=10) had to be removed from studies by day 21 due to tumour size. However, both bispecific antibodies STIM001_457 and STIM003_457 demonstrated good efficacy when used as the sole therapy in this model with, respectively, 50% and 62.5% of the animals cured from their disease by day 37. The anti-tumour efficacy of both bispecific antibodies resulted in improved overall survival of the treated animals (time on study) which was significant vs saline treated group for both antibodies (p<0.05 for STIM003_457 and p<0.001 for STIM001_457). See FIG. 15 and FIG. 16. Table E10-2 below shows hazard ratio (logrank) and p value for the different treatment comparisons.

TABLE E10-2

| Conditions | P value (Log Rank, Mantel-Cox) | Hazard Ratio (logrank) |
| --- | --- | --- |
| Saline vs STIM003_457 | P < 0.05 | 2.622 |
| Saline vs STIM001_457 | P < 0.001 | 5.011 |
| STIM003_457 vs STIM001_457 | Not Significant | 1.498 |

Example 11a Anti-Tumour Efficacy of ICOS/PD-L1 Bispecific Antibody on CT26 Tumours In Vivo This example demonstrates strong anti-tumour efficacy in vivo in a CT-26 syngeneic model by co-targeting ICOS and PD-L1 using a bispecific antibody. Bispecific mAb$^2$ STIM001_457 hIgG1 and STIM003_457 hIgG1 were both effective in this study.

Method:

Efficacy studies were performed in BALB/c mice using the sub-cutaneous CT-26 colon carcinoma model (ATCC, CRL-2638). BALB/c mice were supplied by Charles River UK at 6-8 weeks of age and >18 g and housed under specific pathogen-free conditions. A total of 1×10E5 CT-26 cells (passage number below P20) were subcutaneously injected into the right flanks of mice. Unless stated otherwise, treatments were initiated at day 6 post tumour cells injection. The CT-26 cells were passaged in vitro by using TrypLE™ Express Enzyme (Thermofisher), washed twice in PBS and resuspended in RPMI supplemented with 10% foetal calf serum. Cell viability was confirmed to be above 90% at the time of tumour cell injection.

STIM001_457 or STIM003_457 bispecific mAb$^2$ antibody was each used as the sole therapeutic agent. These antibodies bind to mouse ICOS via the Fab domains and to mouse PD-L1 via the Fc domain (Fcab). Bispecific antibodies were dosed intraperitoneal (IP) at 200 μg each (1 mg/ml in 0.9% saline) three times per week from day 6 (dosing for 2 weeks between day 6-17) post tumour cell implantation. Tumour growth was monitored and compared with tumours of animals in a saline-treated control group and with an isotype IgG1_457 control mAb$^2$ antibody which binds to mouse PD-L1 but does not bind to ICOS. Animal weight and tumour volume were measured 3 times per week from the day of tumour cell injection. Tumour volume was calculated by use of the modified ellipsoid formula ½(Length× Width2). Mice were kept on studies until their tumour reached an average diameter of 12 mm3 or, rarely, when incidence of tumour ulceration was observed (welfare). Mice were re-challenged at day 50. The humane endpoint survival statistics were calculated using the Kaplan-Meier method with Prism. This approach was used to determine if specific treatments were associated with improved survival.

TABLE 11a-1

| | | Bispecific antibody treatment groups in the CT26 model. |
| --- | --- | --- |
| Groups | Number of animals | Treatment regimen (dosed I.P. 3 time a week from day 6 for 2 weeks) |
| 1 | 10 | Saline |
| 2 | 10 | IgG1_457 Fc effector-disabled (LAGA) control 200 μg per dose |
| 3 | 10 | STIM003_457 200 μg per dose |
| 4 | 10 | STIM001_457 200 μg per dose |

Results:

The present experiment clearly demonstrates that both bispecific antibodies significantly delayed tumour growth and extended the survival (time to reach humane endpoint/time on study) of treated animals when compared to saline or IgG1_487 LAGA treated animals. When administered individually as monotherapies rather than in combination, anti-ICOS and anti-PD-L1 antibodies were each significantly less effective at preventing CT26 tumours compared with the bispecific antibodies (data not shown).

In this experiment STIM003_457 antibody was more effective at inhibiting tumour growth than STIM001_457. STIM003_457 demonstrated the strongest anti-tumour efficacy and improved survival (60% were cured from the disease at day 50) whereas STIM001_457 resulted in 3 out 10 animals (30%) with no sign of disease at the end of the study (day 50). See FIG. 17.

Figure 18:
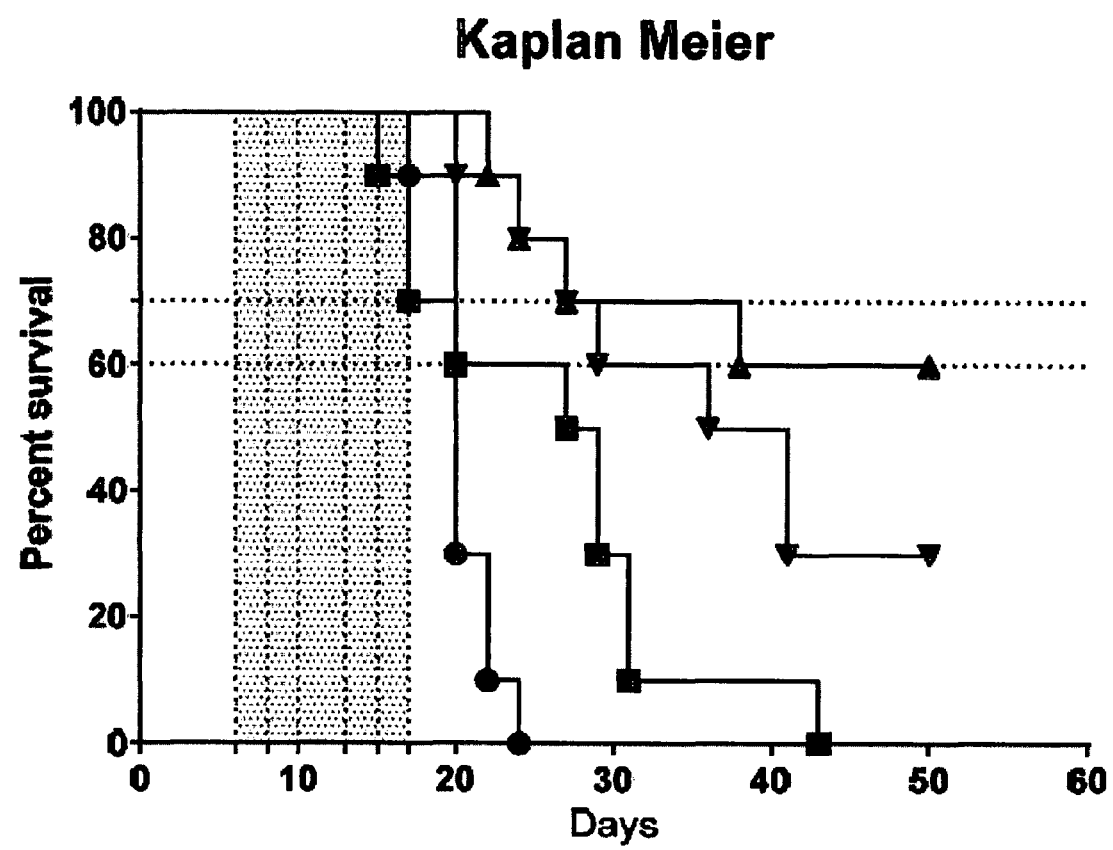
FIG. 18 Kaplan Meier plot for CT26 study described in Example 11a. Circles: saline control. Squares: IgG1_487 control. Up triangles: STIM003_457. Down triangles: STIM001_457.
Figure 21:
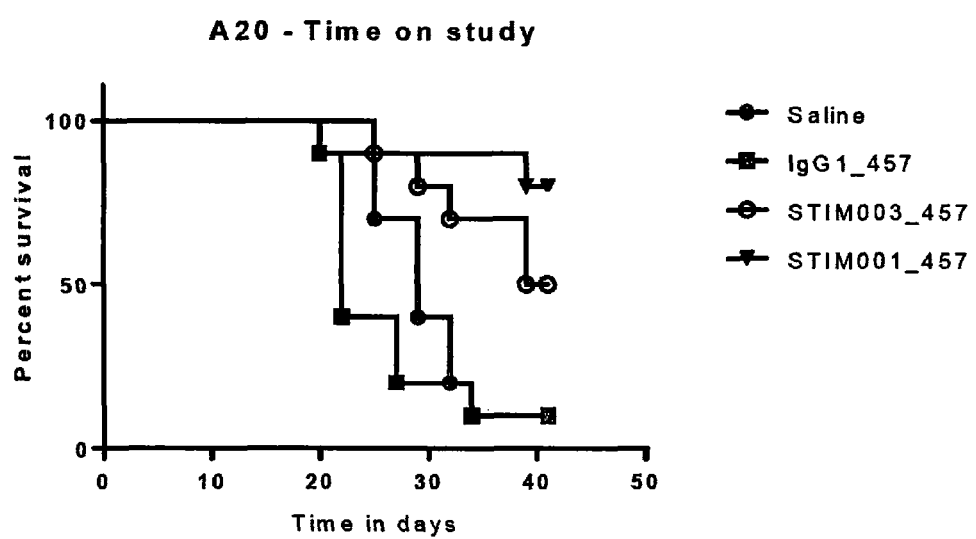
FIG. 21 Results of A20 in vivo efficacy study described in Example 12. The humane endpoint survival statistics were calculated from the Kaplan-Meier curves using Graph Pad Prism V7.0. This approach was used to determine if specific treatments were associated with improved survival.

The humane endpoint survival statistics were calculated using the Kaplan-Meier method with Prism. This approach was used to determine if specific treatments were associated with improved survival. See FIG. 18.

TABLE 11a-2

| conditions (A vs B) | P value Log-rank (Mantel-Cox) test | Hazard Ratio (Mantel-Haenszel A vs B) |
| --- | --- | --- |
| Saline vs STIM003_457 | P < 0.0001 | 19.71 |
| saline vs STIM001_457 | P < 0.0001 | 17.55 |
| STIM003_457 vs STIM001_457 | 0.2831 (not significant) | 0.5155 |

These data confirm that co-targeting ICOS and PD-L1 using a bispecific antibody, even as the sole treatment agent, is effective to trigger an anti-tumour response in the CT26 model.

Example 11b Treatment with Bispecific ICOS/PD-L1 Antibody Induces Long-Term Immune Memory to Tumour Antigens Animals that showed full tumour regression following treatment with the bispecific antibodies in Example 11a were challenged again with tumour cells. Of a total of 9 animals, 5 were re-challenged with CT26 to determine whether the animals' immune system showed a memory response to CT26 cells that could prevent these tumours from growing post re-challenge implantation. In addition, 4 animals were challenged with implanted EMT-6 tumour cells, which their immune systems had not been exposed to previously.

TABLE 11b

| Bispecific antibody re-challenge groups | | |
|---|---|---|
| Animal ID number | Previous treatment groups | Cells implanted (re-challenge) |
| CB43 | STIM003_457 | CT-26 |
| FCA5 | STIM003_457 | CT-26 |
| 1147 | STIM003_457 | CT-26 |
| FEDD | STIM001_457 | CT-26 |
| A6E7 | STIM001_457 | CT-26 |
| E692 | STIM003_457 | EMT-6 |
| C687 | STIM003_457 | EMT-6 |
| D063 | STIM003_457 | EMT-6 |
| FC52 | STIM001_457 | EMT-6 |

Results are shown in FIG. 19. All the animals that had rejected the CT-26 tumours in response to one of the two ICOS/PD-L1 bispecifics managed to reject the newly-injected CT-26 cells in the absence of further treatment. On the other hand, animals that were injected with the new cell line EMT-6, all quickly demonstrated the presence of an established EMT-6 tumour. Altogether the data demonstrate that animals that previously rejected CT-26 tumour in response to either of the bispecific antibody treatments were fully resistant to the CT-26 tumour but not to the unrelated EMT6 tumour. This result indicates that the mice cured by the bispecific antibody therapy had established a long-term memory to tumour antigens expressed specifically by the CT-26 tumour.

Example 12 Anti-Tumour Efficacy of ICOS-PD-L1 Bispecific Antibody on A20 Tumours In Vivo ICOS/PD-L1 bispecific antibodies STIM001_457 and STIM003_457 showed strong anti-tumour efficacy in vivo in the A20 syngeneic model when used as sole therapy.

Method:

Efficacy studies were performed in BALB/c mice using the sub-cutaneous A20 Reticulum Cell Sarcoma model (ATCC number CRL-TIB-208). BALB/c mice were supplied by Charles River UK at 6-8 weeks of age and >18 g and housed under specific pathogen-free conditions. A total of 5×10E5 A20 cells (passage number below P20) were subcutaneously injected into the right flanks of mice. Unless stated otherwise, treatment was initiated at day 8 post tumour cells injection. The A20 cells were passaged in vitro by using TrypLE™ Express Enzyme (Thermofisher), washed twice in PBS and resuspended in RPMI supplemented with 10% foetal calf serum. Cell viability was confirmed to be above 85% at the time of tumour cell injection.

The antibodies were dosed intraperitoneally (IP) at 200 µg each (1 mg/ml in 0.9% saline) twice per week from day 8 (dosing for 3 weeks between day 8-25, six doses in total) post tumour cell implantation. Tumour growth was monitored and compared to tumours of animals treated with a IgG2a isotype control group and IgG1_457 (anti-PD-L1 control). Animal weight and tumour volume were measured 3 times a week from the day of tumour cell injection. Tumour volume was calculated by use of the modified ellipsoid formula ½(Length×Width$^2$). Mice were kept on study until their tumour reached an average diameter of 12 mm$^3$ or, rarely, when incidence of tumour ulceration was observed (welfare).

TABLE E12-1

| Bispecific antibody treatment groups. | | |
|---|---|---|
| Groups | Number of animals | Treatment regimen |
| 1 | 10 | IgG2a isotype control |
| 2 | 10 | IgG1_457 |
| 3 | 10 | STIM003_457 |
| 4 | 10 | STIM001_457 |

Results:

The STIM001_457 and STIM003_457 bispecific antibodies significantly delayed the growth of A20 sub-cutaneous tumours and resulted in extended survival (time to reach humane endpoint) of the treated animals when compared to IgG2a isotype control or IgG1_487 treated animals. All animals in the two control groups had to be removed from the study by day 40. Notably, both bispecific antibodies demonstrated a strong anti-tumour efficacy with 40 and 70% of the animals presented no signs of the disease at day 41. See FIG. 20 and FIG. 21.

Example 13 Anti-Tumour Efficacy of ICOS/PD-L1 Bispecific Antibody on EMT6 Tumours In Vivo Anti-tumour in vivo efficacy of co-targeting ICOS and PD-L1 with bispecific antibodies was assessed in an EMT-6 syngeneic model using STIM001_457 and STIM003_457.

Method:

Efficacy studies were performed in BALB/c mice using the sub-cutaneous EMT-6 breast carcinoma model (ATCC number CRL-2755). BALB/c mice were supplied by Charles River UK at 6-8 weeks of age and >18 g and housed under specific pathogen-free conditions. A total of 2.5×10E5 EMT-6 cells (passage number below P20) were subcutaneously injected into the right flanks of mice. Unless stated otherwise, treatments were initiated at day 6 post tumour cells injection. The EMT-6 cells were passaged in vitro by using TrypLE™ Express Enzyme (Thermofisher), washed twice in PBS and resuspended in Waymouths MB 752/1 with 2 mM L-glutamine and supplemented with 15% foetal calf serum. Cell viability was confirmed to be above 90% at the time of tumour cell injection.

STIM001_457 and STIM003_457 were each used as single therapeutic agents, dosed intraperitoneally (IP) at 200 µg (1 mg/ml in 0.9% saline) twice a week from day 6 (dosing for 3 weeks between day 6-23) post tumour cell implantation. Tumour growth was monitored and compared to tumours of control animals treated with a saline and IgG1_457 LAGA control. IgG1_457 LAGA can bind PD-L1 and block PD1-PD-L1 interaction but does not bind to ICOS. Animal weight and tumour volume were measured 3 times per week from the day of tumour cell injection. Tumour volume was calculated by use of the modified ellipsoid formula ½(Length×Width2). Mice were kept on studies until their tumour reached an average diameter of 12 mm3 or, rarely, when incidence of tumour ulceration was observed (welfare).

Table E13-1

| Bispecific antibody treatment groups. | | |
|---|---|---|
| Groups | Number of animals | Treatment regimen |
| 1 | 10 | Saline |
| 7 | 10 | IgG1_457 Fc effector-disabled (LAGA) mAb$^2$ 200 ug per dose |

Table E13-1-continued

Bispecific antibody treatment groups.

| Groups | Number of animals | Treatment regimen |
|---|---|---|
| 8 | 10 | STIM003_457 200 ug per dose |
| 9 | 10 | STIM001_457 200 ug per dose |

Figure 23:
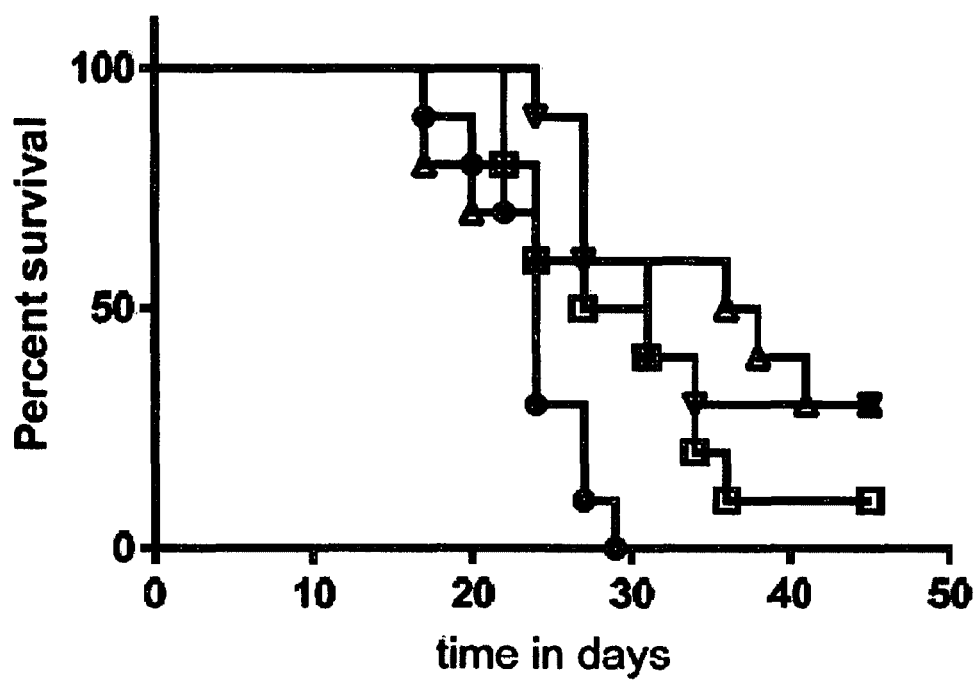
FIG. 23 Survival (time on study) for the animals treated with saline (black circles), anti-PD-L1 mAb² control antibody (squares), STIM003_457 (up triangles), or STIM001_457 (down triangles), as described in Example 13. Both ICOS/PD-L1 bispecific antibodies significantly improved the overall survival of animals compared with those treated with saline.

Results:

Data are shown in FIG. 22 and FIG. 23, and in Table E13-2 below.

Both bispecific antibodies significantly delayed EMT6 tumour growth and resulted in a longer survival (time to reach humane endpoint) when compared with animals treated with saline or IgG1_457 LAGA. STIM001_457 was marginally more potent in this model and resulted in the strongest anti-tumour efficacy and improved survival (30% vs 20% were cured from the disease at day 44 for STIM001_457 and STIM003_457, respectively), however this difference is not significant. Interestingly the IgG1_457 LAGA treatment resulted in tumour growth delay (vs saline treated group) but unlike what was observed for the ICOS/PD-L1 bispecific, this efficacy did not result in complete response (i.e., absence of tumour at the end of the experiment).

TABLE E13-2

P value and the hazard ratio for different treatment comparisons. The statistics were calculated with Prism.

| Conditions (A vs B) | P value Log-rank (Mantel-Cox) test | Hazard Ratio (Mantel-Haenszel A vs B) |
|---|---|---|
| Saline vs STIM003_457 200 ug | 0.0304 | 3.676 |
| Saline vs STIM001_457 200 ug | 0.0009 | 8.683 |
| IgG1_457 LAGA 200 ug vs STIM003_457 200 ug | 0.2641 | 1.839 |
| IgG1_457 LAGA 200 ug vs STIM001_457 200 ug | 0.3174 | 1.741 |
| STIM003_457 200 ug vs STIM001_457 200 ug | 0.9692 | 1.022 |

Comparing the ICOS/PD-L1 bispecific mAb$^2$ antibodies with two separate monoclonal antibodies (anti-ICOS STIM003 and anti-PD-L1 antibody), the bispecific mAb$^2$ antibodies showed efficacy where the combination did not. See FIG. 24 and FIG. 25.

Example 14 Anti-ICOS Agonism of MJ T Cells in PD-L1-Dependent Assay

In this ICOS-dependent T cell activation assay, the agonistic potentials of STIM001_289 and STIM003_289 bispecific antibodies were compared with those of STIM001 and STIM003 IgG1 monoclonal antibodies as well as the isotype controls of both the bispecific and monoclonal antibodies in a cell stimulation assay. ICOS expressing MJ cells were stimulated and IFN-γ at 72 hrs post-activation was measured as the readout. This assay can be used to assess the ability of the PD-L1 binding site of the bispecific antibody to present the antibody in a way that promotes activation of target cells through ICOS signalling.

PDL1-dependent release of IFN-γ by the target cells could only be seen with the molecules that bind both ICOS and PDL1 (B7-H1). There was no significant IFN-γ release above background for any of the antibodies when these were added to plates pre-coated with the negative control (BSA). When the positive control Goat anti-human IgG Fcg fragment specific F(ab')2, which binds the Fc-domains of both the bispecific and the IgG1 monoclonal antibodies, was coated on the plates, all antibodies that bind ICOS, i.e. STIM001_289, STIM003_289, STIM001 IgG1 and STIM003 IgG1 could induce IFN-γ release, whereas the isotype controls could not. When the plates were coated with PDL1-Fc, only STIM001_289 and STIM003_289 were able to induce IFN-γ, whereas the HYB.CTRL_289, which is not able to bind ICOS, did not. Similarly, the IgG1s, which are unable to bind PDL1 did not induce the release of IFN-γ. Altogether, this experiment demonstrates that the bispecific antibodies can induce PDL1-dependent ICOS agonism.

Materials and Methods

Plate Coating 96-well, sterile, flat, high binding plates (Costar) were coated in duplicate overnight at 4° C. with 100 μl/well of DPBS (Gibco) containing either 1% w/v of bovine serum albumin (BSA; Sigma) or 10 μg/ml of recombinant human B7-H1-Fc chimera (RnD Systems) or 10 μg/ml goat anti-human IgG Fcg fragment specific F(ab')2 (Jackson ImmunoResearch). Plates were then washed twice with 200 μl/well of DPBS and blocked with 1% BSA for 1 hr at room temperature (RT). The plates were then washed again twice with 200 μl/well of DPBS before the addition of serial dilutions of antibodies.

Antibody Addition

Serial 1:3 dilutions of STIM001, STIM003 and HYB. CTRL (isotype control) as an IgG1 and STIM001_289, STIM003_289 and HYB. CTRL_289 from 10 μg/ml to 0.51 ng/ml were prepared in 1% BSA/DPBS, added to the plates and agitated for 1.5 hrs at RT. The plates were washed again 2× with PBS before the addition of MJ cells. To account for background, several wells of the plate were left empty and to enable calculation of percent effect several wells were stimulated with the Cell Stimulation Cocktail (1/20×; eBioscience).

Cell Stimulation

MJ [G11] cell line (ATCC© CRL-8294™) was grown in IMDM (Gibco or ATCC) supplemented with 20% heat inactivated FBS. The cells were counted and 10000 cells/well (100 μl/well) of cell suspension was added to the protein coated plates. Cells were cultured in the plates for 3 days at 37° C. and 5% CO$_2$. Cells were separated from the media by centrifugation and the supernatants collected for IFN-γ content determination.

Measuring IFN-γ Levels

The IFN-γ content in each well was determined using a modification of the Human IFN-gamma DuoSet ELISA kit (R&D systems). Capture antibody (50 μl/well) was coated overnight at 4 μg/ml in DPBS on black flat bottom, high binding plates (Greiner). The wells were washed three times with 200 μl/well of DPBS+0.1% Tween. The wells were blocked with 200 μl/well of 1% BSA in DPBS (w/v), washed three times with 200 μl/well of DPBS+0.1% Tween and then 50 μl/well of either the IFN-γ standard solutions in RPMI or neat cell supernatant were added to each well. The wells were washed three times with 200 μl/well of DPBS+0.1% Tween before adding 50 μl/well of the detection antibody at 200 ng/ml in DPBS+0.1% BSA. The wells were washed three times with 200 μl/well of DPBS+0.1% Tween before adding 50 μl/well of streptavidin-europium (Perkin Elmer) diluted 1:500 in Assay buffer (Perkin Elmer). The wells were washed three times with 200 μl/well of TBS+0.1% Tween before developing the assay by adding 50 μl/well of Delfia enhancement solution (Perkin Elmer) and measuring the fluorescence emitted at 615 nm on the EnVision Multilabel Plate Reader.

Data Analysis

IFN-γ values for each well were extrapolated from the standard curve and the average background levels from media-only wells were subtracted. The percent effect was calculated as the fraction of signal compared to the IFN-γ values obtained from wells stimulated with the Cell Stimulation Cocktail. The percent effect values were then used in Graph Pad prism to fit a 4-parameter log-logistic concentration response curve.

Results

Figure 26A:
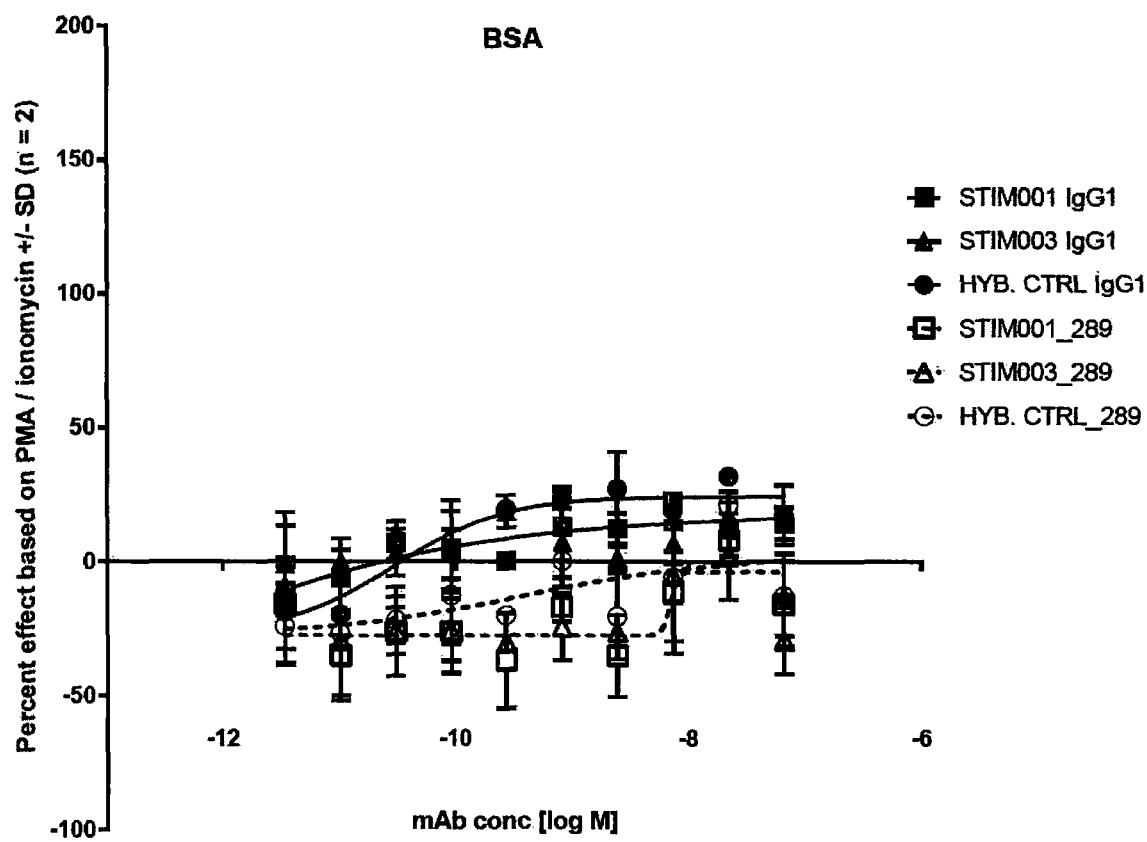
FIG. 26 Representative example from two independent experiments in the PD-L1 dependent ICOS agonism assay reported in Example 14. (A) BSA. (B) B7-H1-Fc. (C) Goat anti-human IgG Fcg fragment specific F(ab')2.
Figure 26B:
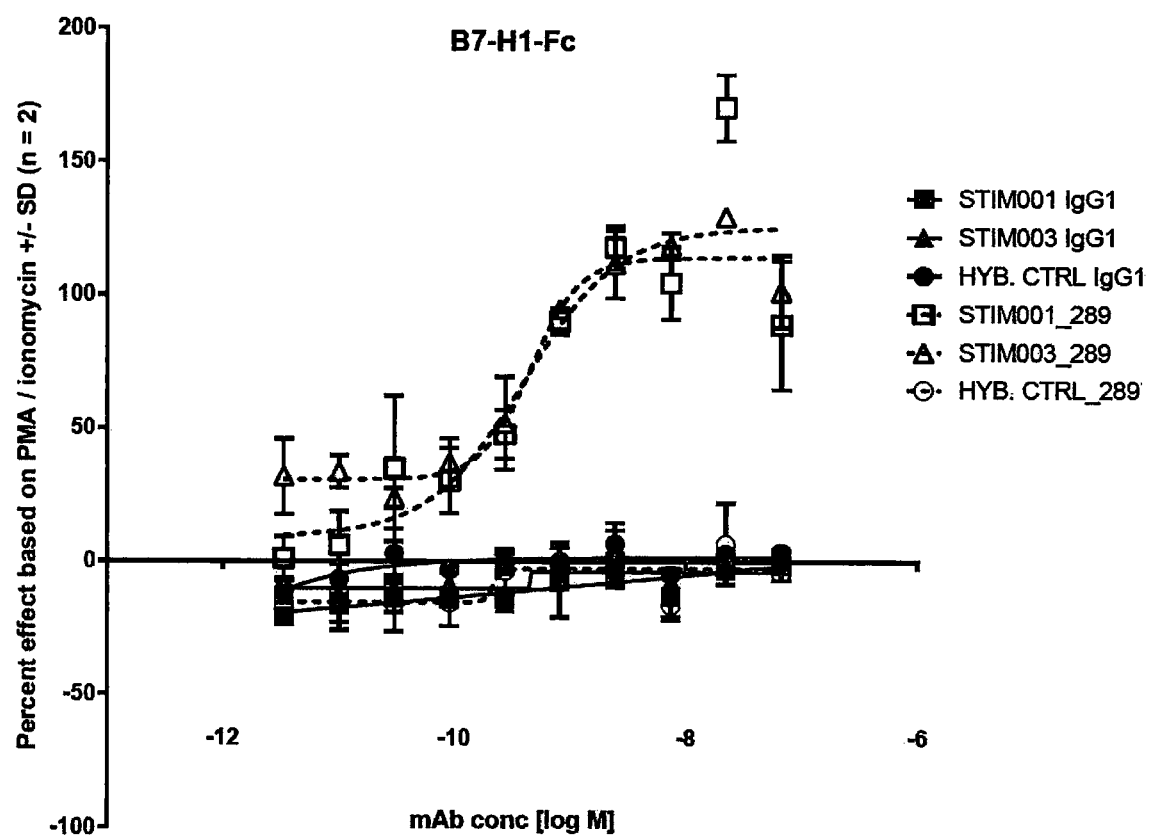
Figure 26C:
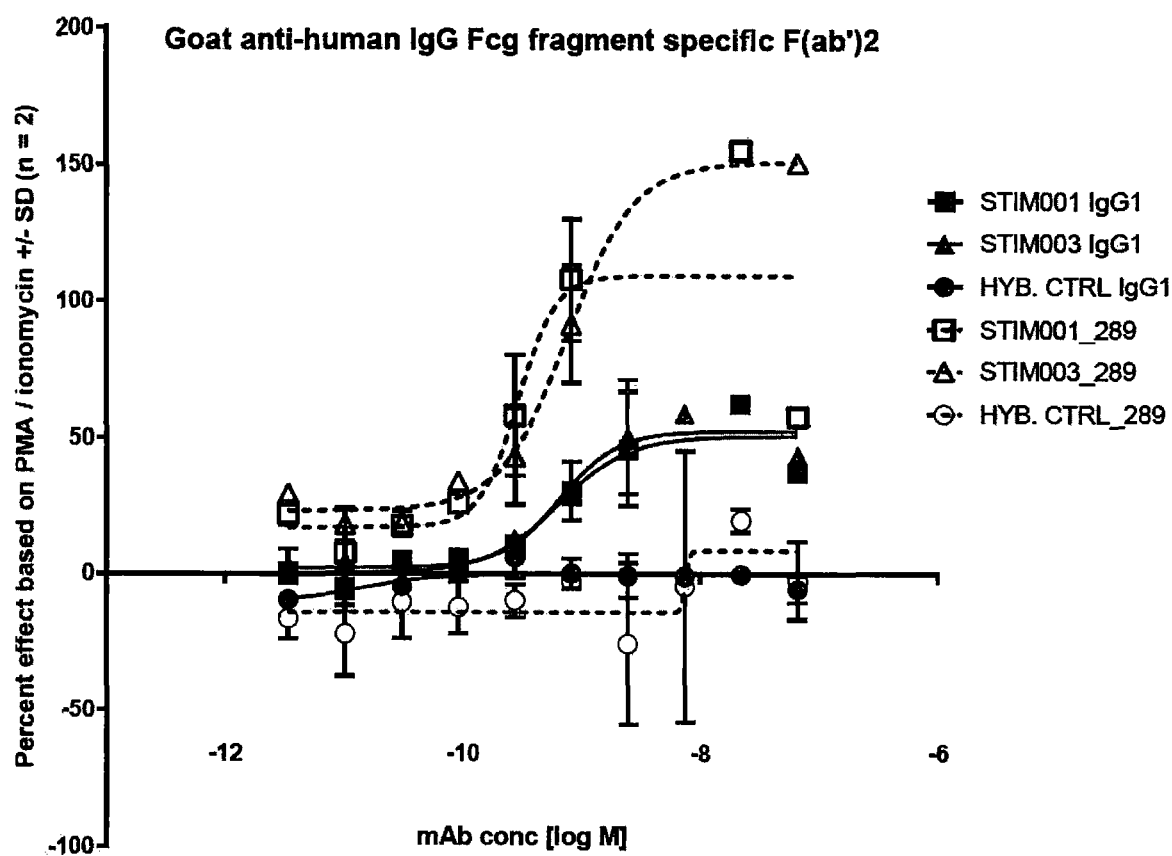

FIG. 26 shows a representative example from two independent experiments.

PDL1-dependent release of IFN-γ by ICOS positive cells could only be seen with the molecules that bind both ICOS and PDL1 (B7-H1). There was no significant IFN-γ release above the background for any of the antibodies when these were added to plates pre-coated with the negative control (BSA). When the positive control Goat anti-human IgG Fcg fragment specific F(ab')2 was coated on the plates, all antibodies that bind ICOS, i.e. STIM001_289, STIM003_289, STIM001 IgG1 and STIM003 IgG1 could induce IFN-γ release, whereas the isotype controls could not. When the plates were coated with PDL1-Fc, only STIM001_289 and STIM003_289 were able to induce IFN-γ, whereas the HYB. CTRL_289, which is not able to bind ICOS, did not. Similarly, the IgG1s, which are unable to bind PDL1 did not induce the release of IFN-γ. Altogether, this experiment demonstrates that the bi-specific antibodies can induce PDL1-dependent ICOS agonism.

Example 15 Formation of Intercellular Bridge by ICOS/PD-L1 Bispecific Antibody

This Example provides data indicating that the mAb2 bispecific antibodies of the invention are able to bridge cells expressing ICOS and PD-L1 respectively, in the manner illustrated in FIG. 1.

A flow cytometry protocol was developed to assess the ability of the mAb$^2$ STIM001_289 and STIM003_289 to promote the bridging of cells expressing ICOS and cells expressing PD-L1. This experiment aimed to demonstrate that the mAb2 can link cells expressing the targets. This data will ultimately be critical to demonstrate that the mAb2 can trigger agonism of ICOS$^{+ve}$ cells through cross-presentation using PD-L1 positive cells (such as antigen presenting cells and tumour cells). This PD-L1 dependent ICOS agonism is expected to be important part of the mechanism of action of the mAb$^2$ in PD-L1 rich tumour microenvironment. For this purpose, CHO cells expressing human PD-L1 were stained with CellTrace™ Far Red (Invitrogen C34572) which emits at 661 nm while CHO cells expressing human ICOS were stained with CellTrace™ Violet (Invitrogen C34571) which emits at 450 nm. Stained cells were incubated with a titration of mAb$^2$ antibodies or a combination of the parental monospecific antibodies and then processed with a flow cytometer.

Material and Methods

CHO human PD-L1 and CHO human ICOS cells were harvested, counted, washed, and re-suspended in PBS (Gibco 14190169) at 1 million cells per mL. CellTrace™ Far Red and CellTrace™ Violet dyes were diluted 1:2000 and incubated with their respective cells for 20 min at 37° C. in the dark, according to manufacturer recommendations. Buffer (PBS (Gibco 14190169), 1% BSA (Sigma) 0.1% Na Azide (Severn Biotech 40-2010-01)) was then added in excess for an additional 5-minute incubation step. Cells were spun down, re-suspended in the above buffer at 2 million cells per mL and incubated for at least 10 minutes at 37° C. before proceeding with binding protocol. Unstained cells were kept and used to set up the gating strategy.

MAb$^2$ STIM001_289 and STIM003_289, human IgG1 and Hybrid_289 were prepared in buffer at 450 nM and diluted as per 1:3 series, 11 points in triplicates. 50 μL of CHO human PD-L1 cells labelled with CellTrace™ Far Red, 50 μL of CHO human ICOS labelled with CellTrace™ Violet and 50 μL of antibody were added to a 96 well V-bottom PS plate (Greiner 651901).

The monospecific antibodies STIM001 and STIM003, as well as the Hybrid_289 were prepared in buffer at 900 nM and diluted as per 1:3 series, 11 points in triplicates. 25 μL of STIM001 or STIM003 were added to 25 μL of Hybrid_289, 50 μL of labelled CHO human PD-L1 and 50 μL of CHO human ICOS in a 96 well V-bottom PS plate.

Assay plates were incubated at room temperature for 1 hour under gentle agitation (450 rpm) before being read using the Attune NxT flow cytometer (Thermo Fisher) for the detection of fluorescence at 661 nm and 450 nm. FCS files were analysed with FlowJo® software V7.00. Single cells and duplets were gated based on the forward and side scatter dot plot.

Results

Figure 27:
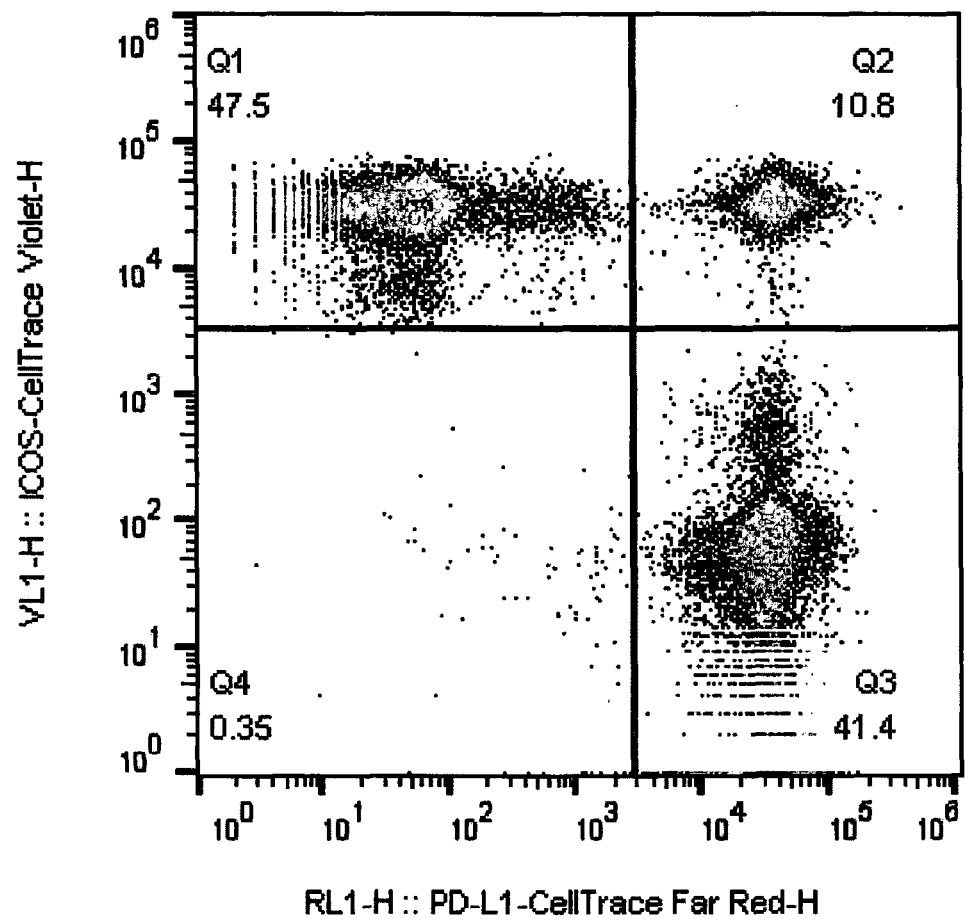
FIG. 27 Identification of four different quadrants on dot plot graph for mAb² antibodies in a PD-L1/ICOS cell recruitment assay by flow cytometry.

Dot plots graphs (see FIG. 27) resulted in the identification of four different gates: a double negative quadrant corresponding to a very small population (Q4 in FIG. 27) of unstained CHO human PD-L1 and unstained CHO human ICOS; two quadrants positive for one of the two fluorophores (either at 661 nm [PD-L1 CHO cells, Q3 in FIG. 27] or at 450 nm [ICOS CHO cells, Q1 in FIG. 27]); and a quadrant of dual positive staining (at 661 nm and 450 nm, Q2 in FIG. 27) composed of stained PD-L1 and ICOS CHO cells. Cells were seen in this quadrant only when the ICOS/PD-L1 mAb$^2$ were used. Percentages of double positive cells were plotted into Prism against antibody titrations.

Figure 28:
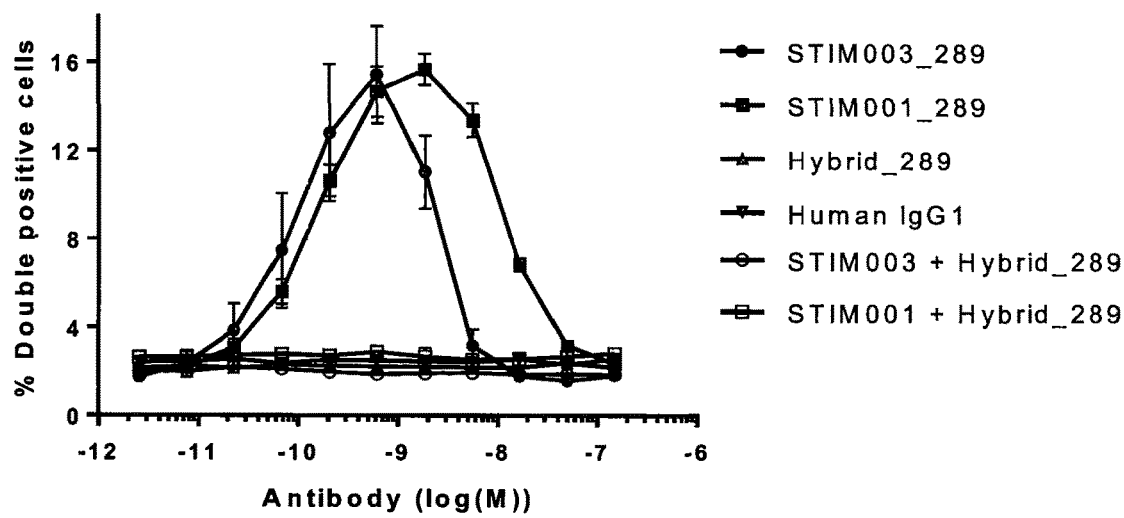
FIG. 28 Titration of mAb² and monospecific antibodies in a PD-L1/ICOS cell recruitment assay by flow cytometry. CHO human PD-L1 and CHO human ICOS were stained with CellTrace™ Far Red and CellTrace™ Violet respectively and incubated together in presence of antibodies for an hour prior to the detection of fluorescence and identification of double positive population. Data shown are representative of two independent experiments.

Using as baseline the average percentage of double positive cells obtained with the human IgG1 isotype control, the areas under curve were also calculated for each condition. The highest area under curve was obtained for antibodies able to recruit the most of PD-L1 and ICOS cells and for the widest range of concentrations. See Table E15 and FIG. 28.

TABLE E15

| Area under curve | | |
| --- | --- | --- |
| STIM003_289 | 19.43 | |
| STIM001_289 | 25.45 | |
| Hybrid_289 | 1.22 | |
| Human IgG1 | 0.21 | |
| STIM003 + Hybrid_289 | 2.45 | |
| STIM001 + Hybrid_289 | 0.89 | |
| Baseline | 2.50 | % Double positive Cells |

MAb$^2$ STIM001_289 and STIM003_289 were able to recruit cells expressing human PD-L1 with cells expressing human ICOS. This data confirmed that the mAb$^2$ were able to link/bridge ICOS and PD-L1 positive cells such as effector T cells and APC cells, respectively.

At low concentrations of mAb$^2$, there was not enough antibody to bind two cell lines. The maximal percentage of double positive cells was reached when the concentration of mAb$^2$ was optimal to recruit the two cell lines (at 1.85 nM for STIM001_289 and at 0.7 nM for STIM003_289). At high concentrations of mAb² antibody, a decrease in the percentage (bell shape curve) of double positive cells was observed. This is expected to be due to saturation of target binding on individual cells by the excess of the antibody. The targets of the CHO human PD-L1 cells and the targets of the CHO human ICOS were both saturated with high mAb² concentration therefore a same mAb² is not able to simultaneously bind two cells.

STIM001_289 could reach the same maximum of double positive cells (~16%) to STIM003_289, but the double positive signal was observed over a wider range of concentrations for STIM001_289. This was confirmed by a higher area under curve for STIM001_289 than for STIM003_289. This difference may be explained by the different affinities of STIM001 and STIM003 for human ICOS. Altogether, this data confirmed the ability of the mAb² STIM001_289 and STIM003_289 to bridge ICOS and PD-L1 positive cells, such as effector and APC/tumour cells. This demonstrates the potential of triggering PD-L1 dependent cross presentation of the Mab2 to ICOS cells which would be a prerequisite to PD-L1 dependent ICOS agonism.

Example 16 Pharmacodynamic Study of Tumour and Spleen Treated with STIM003_457 or STIM001_457 in the CT26-WT Model Methods To ascertain the effects of the bispecific antibodies on certain immune cells in the tumour microenvironment (TME) and peripheral tissue, STIM003_457 and STIM001_457 were given IP twice to CT26-WT tumour-bearing mice. The tumour and spleen were removed for immune cells content analysis by FACS. 24 female BALB/c mice were injected subcutaneously with 0.1×106 cells/mouse of CT26-WT cells, and their tumours allowed to grow. 13 and 15 days post-implantation, mice were dosed intra-peritoneally with either saline, STIM003_457 or STIM001_457 at a fixed dose of 200 tag each. On day 16 post tumour cells-implantation, all mice were culled and tumour, spleen and tumour-draining lymph node (TDLN) were removed for ex vivo analysis. Tumours were dissociated using a mouse tumour dissociation kit (Miltenyi Biotec), followed along with spleen by the MACS gentle dissociator. Spleen cells were incubated for a short period with red blood cell lysis buffer, then all tissues were filtered through 70 μm (tumour) and 40 μm (spleen) cell strainers. The resulting single cell suspensions were washed twice with RPMI+10% FBS complete media, resuspended in FACS buffer and plated into a v-bottomed deep-well 96-well plate. Cells were stained with Live Dead Fixable Yellow viability dye (Life Technologies), followed by washing and an incubation with anti-CD32/CD16 mAb (eBioscience). Afterwards, the following antibodies were added according to three panels: CD3 (17A2), CD45 (30-F11), CD4 (RM4-5), CD8 (53-6.7), CD25 (PC61.5), B220 (RA3-6B2) and ICOS-L (HK5.3), all obtained from eBioscience. Fluorescence-minus-ones were performed in parallel. For staining of intracellular markers (FoxP3), samples were fixed, permeabilized, and stained with FoxP3 mAbs (FJK-16s, eBioscience). Finally, samples were resuspended in PBS and data acquired on the Attune flow cytometer (Invitrogen) and analysed using FlowJo V10 software (Treestar). Gathered data was statistically analysed using the non-parametric Kruskal-Wallis test, followed by post-hoc Dunn's multiple comparisons test (GraphPad Prism V7.0).

STIM003_457 and STIM001_457 Preferentially Deplete TRegs in the TME

Figure 29:
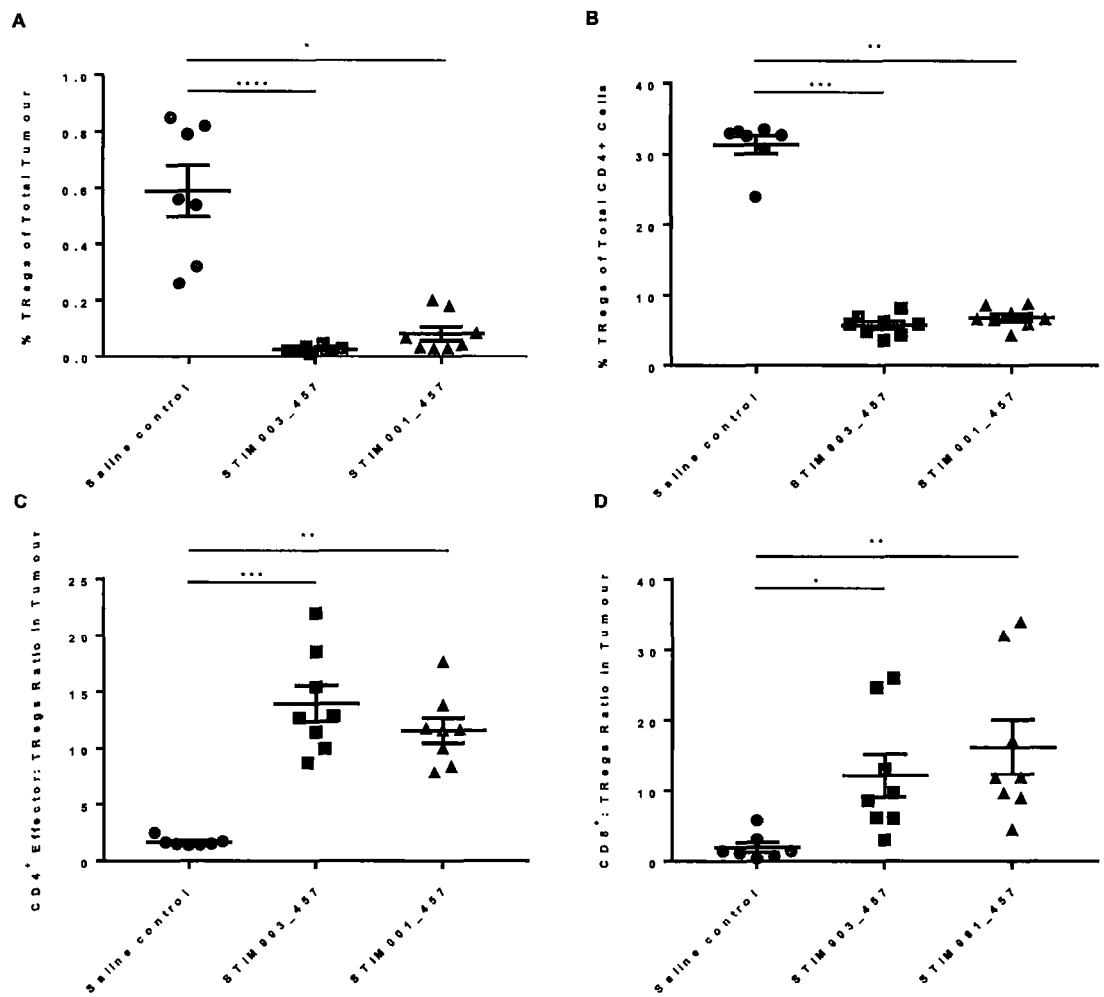
FIG. 29 FACS analysis revealed that STIM003_457 and STIM001_457 significantly deplete regulatory T-cells ($T_{Regs}$) and increase effector cell:$T_{Regs}$ ratio in tumour. Animals (BALB/c mice) were dosed with saline, STIM003_457 or STIM001_457 (n=8 per group) on days 13 and 15 days post-implantation of CT-26.WT tumour cells s/c. Proportion of $T_{Regs}$ of total live tumour cells (A) and of total CD4⁺ cells (B) were significantly decreased in response to both antibodies compared to saline. Ratios of CD4⁺ effector cells to $T_{Regs}$ (C), and of CD8⁺ cells to $T_{Regs}$ (D) are significantly increased compared to the control. Kruskal-Wallis test was performed followed by post-hoc Dunn's test. *$p<0.05$. $p<0.01$. *$p<0.001$. ****$p<0.0001$.

STIM003_457 and STIM001_457 significantly depleted $T_{Regs}$ (defined as $CD4^+$ $CD25^+$ $FoxP3^+$ cells) in the TME when compared to saline (FIGS. 29 A and B). There is a clear reduction in both the percentage of $T_{Regs}$ in the whole tumour (all cells), and also as a percentage of total $CD4^+$ cells. Correspondingly, we saw a significant increase in the effector CD4 and CD8 T cell:$T_{Regs}$ ratios in the tumour. A high effector T cell:$T_{Regs}$ ratio has been previously associated with increased overall survival in cancer patients and is a key indicator of anti-tumour efficacy for immuno-modulatory molecules. FIG. 29C demonstrates the increase in the number of $CD4^+$ effector cells (defined as $CD4^+$ $CD25^-$ $FoxP3^-$ cells) compared to $T_{Regs}$ for both bi-specific antibodies. FIG. 29D shows the same increase in the number of $CD8^+$ cells compared to $T_{Regs}$. The same cell types were investigated in the spleen and as expected, a high/full depletion of $T_{Regs}$ was not observed.

Figure 30:
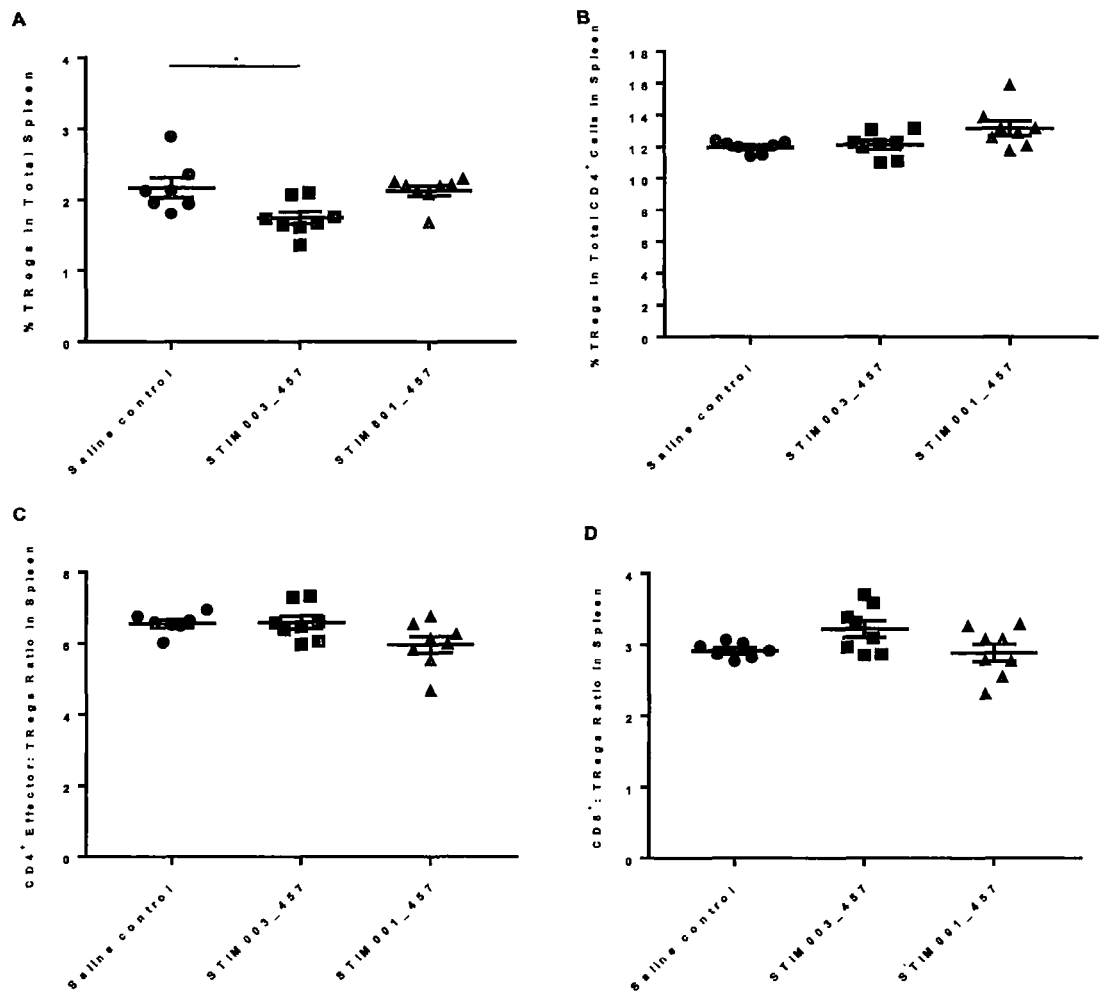
FIG. 30 FACS analysis shows that STIM003_457 and STIM001_457 have little effect on regulatory T-cell ($T_{Regs}$) levels in the spleen of a CT-26.WT tumour-bearing mouse. STIM003_457 shows a marginal $T_{Regs}$ depletion as a percentage of total live cells, but STIM001_457 has no effect (A). No clear changes were observed when looking at the effect of the bispecific on $T_{Regs}$ as a percentage of total CD4⁺ cells (B). No significant changes are seen in CD4⁺ effector cell to $T_{Regs}$ (C), and CD8⁺ cell to $T_{Regs}$ ratios (D). Kruskal-Wallis test was performed followed by post-hoc Dunn's test. *$p<0.05$.

There was only a marginal but yet significant depletion of TRegs in response to STIM003_457 when compared to saline (when TRegs as a percentage of total live cells in the spleen was considered see FIG. 30A). However no significant difference was seen in either antibody group in TRegs as a percentage of total CD4+ cells (see FIG. 30B), and there was no significant increase in effector cell to TRegs ratio in response to either bi-specific antibodies in the spleen. Furthermore, examination of the same cells in the tumour-draining lymph node (TDLN) yielded similar results, with no significant difference in any group in any test (results not shown). Overall, (from the 3 tissues analysed), it can be concluded that STIM003_457 and STIM001_457-mediated a strong and significant TRegs depletion selectively in the TME, which results in an increase of effector T-cells to TReg ratio.

ICOS-L Expression on B-Cells in the Periphery is Increased

Figure 31:
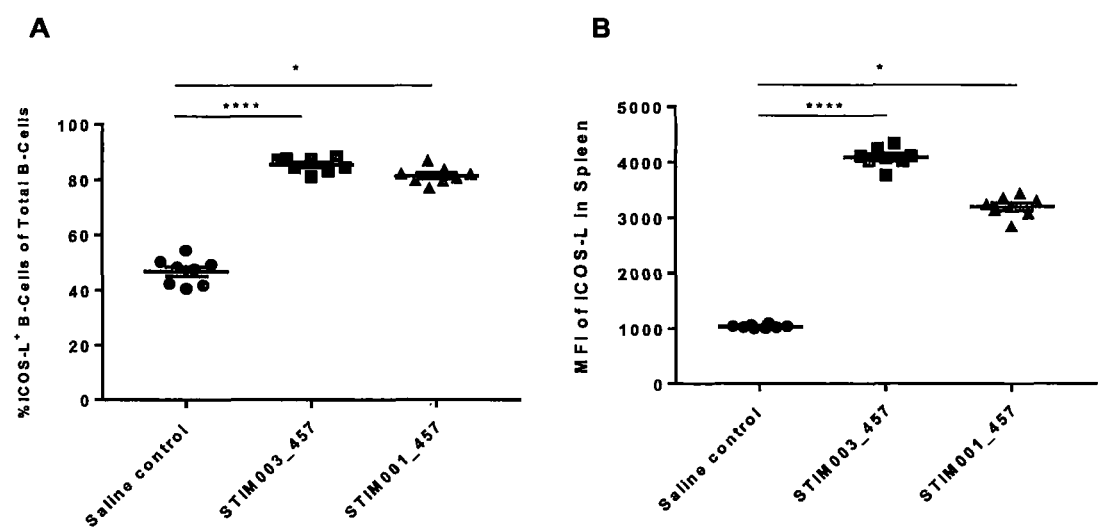
FIG. 31 FACS analysis demonstrates increase in ICOS-Ligand (ICOS-L) expression on B-cells in the spleens of CT26-WT tumour-bearing mice dosed with STIM003_457 and STIM001_457. When compared to saline, both bispecific antibodies caused a significant increase in the percentage of B-cells expressing ICOS-L in the spleen (A). A significant increase in mean fluorescence intensity (relative expression) of ICOS-L on B-cells was also seen in both bi-specific groups compared to the saline group (B). Kruskal-Wallis test was performed followed by post-hoc Dunn's test. *$p<0.05$. **** $p<0.0001$.

The percentage of B-cells (defined as CD45+B220+ cells) which expressed ICOS ligand (ICOS-L) in the spleen was determined by FACS for each treatment group. Both anti-ICOS/anti-PDL1 bispecific antibodies significantly increased the percentage of ICOS-L expressing B-cells by more than 30% when compared to the saline group (see FIG. 31A). The mean fluorescence intensity (MFI) which is used as an indication of ICOS-L relative expression on B-cells was also shown to increase significantly in both groups (see FIG. 31B). In both cases, ICOS-L expression was most increased in animals treated with STIM003_457. Increase in the MFI and in the percentage of ICOS-L-expressing cells indicates that not only was ICOS-L expression more widespread within the B-cell population of antibody-treated animals, but also that expression on each cell was upregulated.

Example 17 Strong Anti-Tumour In Vivo Efficacy in CT26 Syngeneic Model by Combining STIM003_574 with Anti-PD1 (RMT1-14) or Anti-CTLA-4 (4F10)

Efficacy studies were performed in BALB/c mice using the sub-cutaneous CT26 colon carcinoma model (ATCC, CRL-2638). BALB/c mice were supplied by Charles River UK at 6-8 weeks of age and >18 g and housed under specific pathogen-free conditions. A total of 1×10E5 CT26 cells (passage number below P20) were subcutaneously injected into the right flanks of mice. All treatments were initiated at day 6 post tumour cells injection. The CT26 cells were passaged in vitro by using TrypLE™ Express Enzyme (Thermofisher), washed twice in PBS and resuspended in RPMI supplemented with 10% foetal calf serum. Cell viability was confirmed to be above 90% at the time of tumour cell implantation.

In order to assess how the anti-ICOS/anti-PD-L1 bispecific antibody would combined with an anti-PD1 or an anti-CTLA4, we performed an efficacy study experiment using [STIM003_574 hIgG1+/–the PD1 antibody RMT1-14] and [STIM003_574 hIgG1+/–the CTLA antibody 4F10]. For the in vivo efficacy studies, STIM003_574 bi-specific (which binds both mouse ICOS and mouse PD-L1 proteins) was also compared to the efficacy of a combination between the two mAbs STIM003 mIgG2a and anti-PD-L1 (AbW).

In this experiment the antibodies were administered concomitantly by intraperitoneal (IP) injections. All antibodies were diluted in (1 mg/ml in 0.9% saline) and dosed from day 6 (as shown in table below) three times a week for 2 weeks (between day 6-17) post tumour cell implantation. Tumour growth was monitored and compared to tumours of animals treated with saline. Fixed doses of 200 µg or 60 µg were used which correspond to a dose of 10 mg/kg and 3 mg/kg respectively for mice of 20 g. Tumour volume was calculated by use of the modified ellipsoid formula ½(Length×Width$^2$). Animal weight was also recorded 3 times a week from the day of tumour cell injection. Mice were kept on studies until their tumour reached an average diameter of 12 mm$^3$ or, in rare cases, when incidence of tumour ulceration was observed (welfare). The experiment was stopped at day 46 (40 days after the start of the treatment).

TABLE E17

Treatment groups for CT26 study.

| Groups | Number of animals | Treatments and dose (3 times per week for 2 weeks from day 6) |
|---|---|---|
| 1 | 8 | Saline |
| 2 | 8 | STIM003_574 hIgG1 (200 µg) |
| 3 | 8 | aCTLA4 (4F10) (200 µg) |
| 4 | 8 | aPD-1 (RMT1-14) (200 µg) |
| 5 | 8 | STIM003_574 hIgG1/aCTLA4 (4F10) combo (200 µg each) |
| 6 | 8 | STIM003_574 hIgG1/aPD-1(RMT1-14) combo (200 µg each) |
| 7 | 8 | STIM003 mIgG2a (60 µg) + anti-PD-L1 (AbW) (200 µg) |

Figure 32:
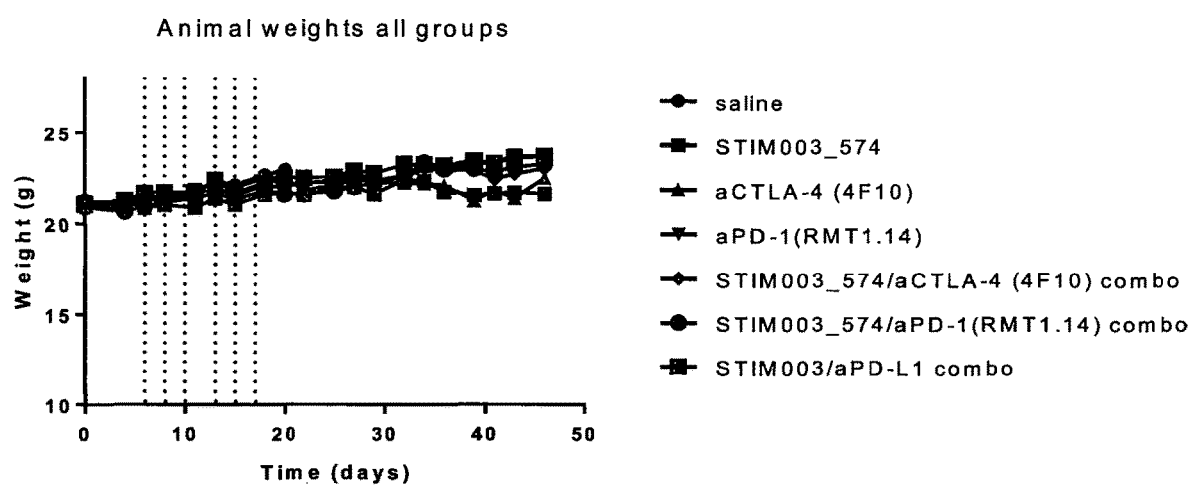
FIG. 32 Graph showing the average weight of the mice over the 46 days for the different treatment groups. Vertical lines indicate the day the animals were dosed IP. Note that the small decrease in average weight observed from day 35 for group 3 (aCTLA-4 monotherapy) and group 7 (STIM003/aPDL1 combination) is due to some animals coming out of the study for tumour size.

The combination of antibodies targeting immune checkpoint (e.g. anti-PD1+anti-CTLA-4) is often associated with adverse events due to the strong activation of the immune system. In the present experiment some of the groups were effectively receiving triple combinations (targeting ICOS, PD-L1 and PD1 or CTLA-4). We used the average animal weight for each group as a surrogate of tolerability of the different treatments. As shown in FIG. 32, we did not observe a decrease in average weight in any of the groups, confirming that these combinations were well tolerated in the animals.

Figure 33:
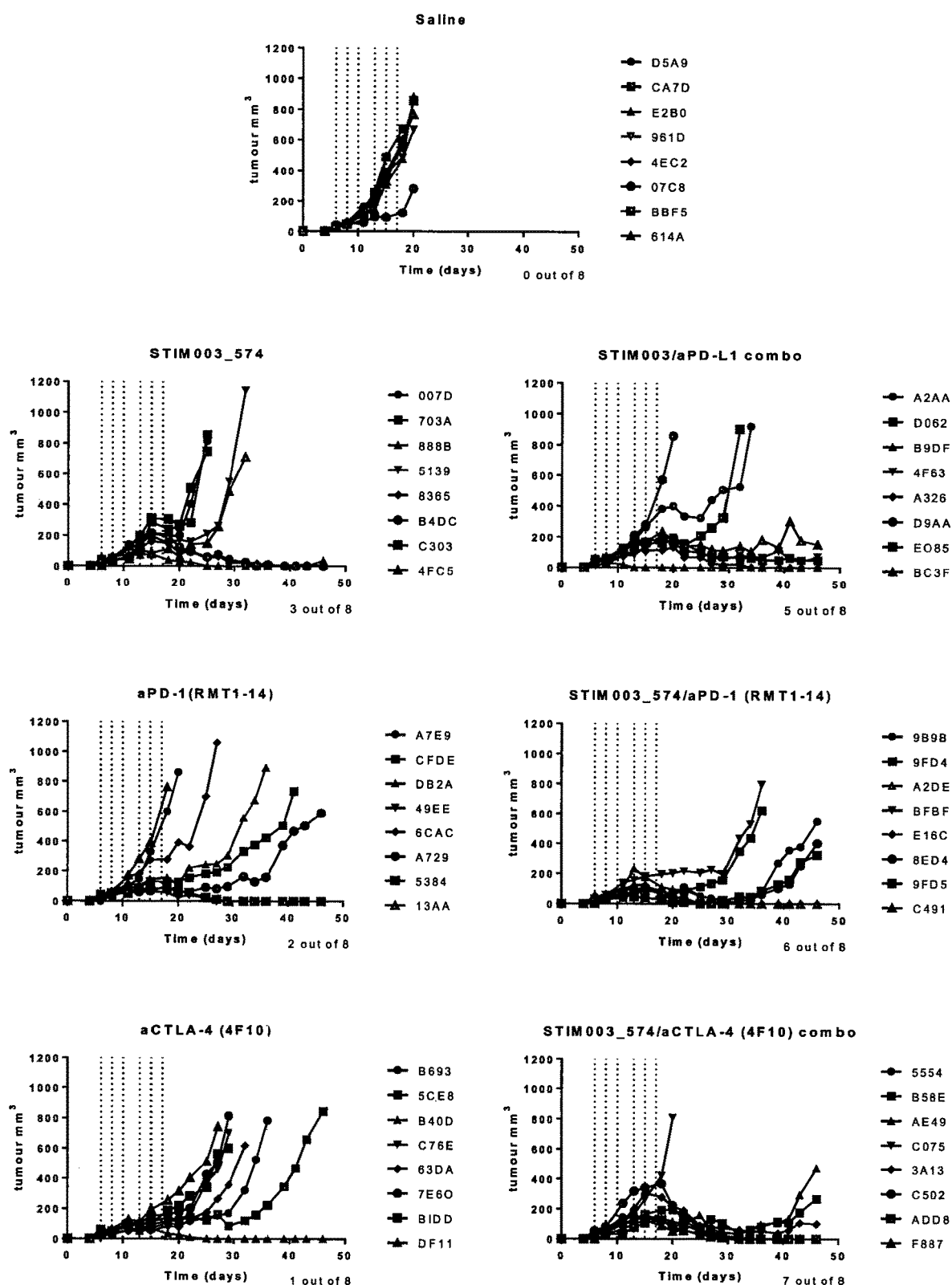
FIG. 33 A to G spider plot graphs showing the CT26 tumour size of individual animals over time in response to the different treatments. The "triple combination" of antibodies (against ICOS, PD-L1 and PD1 or CTLA-4) were associated with the most pronounced anti-tumour response in the CT26 model. Vertical lines indicate the day the animals were dosed IP. For the combination the antibodies were injected concomitantly. The numbers at the bottom right end of each graph indicate the number of animals still on study on day 46 (40 days after the treatments were initiated).

In parallel to monitoring a possible variation in weight, the tumour size for each animal was also measured over 40 days following the start of the treatments (initiated on day 6). As shown in FIG. 33, animals treated with saline had to be sacrificed by day 20 due to tumour size or in one instance due to ulceration of the tumour. On the other hand, the animals treated with STIM003574 and the animals treated with a combination of STIM003 mIgG2a and anti-PD-L1 (AbW) demonstrated an anti-tumour response with, respectively, 37.5% and 62.5% of the animals still on study by day 46. Importantly the anti-tumour efficacy that we observed with STIM003_574 was significantly improved by combining the bi-specific with anti-PD1 or with anti-CTLA-4. Anti-PD1 and anti-CTLA4 monotherapies could trigger an anti-tumour response but this was only for a short term. In fact, only 1 and 2 animals from the anti-PD1 and the anti-CTLA-4 monotherapy groups were still on study on day 46. Whereas the combination of STIM003574 with anti-PD1 or anti-CTLA-4 resulted in 6 and 8 animals respectively still on study by the endpoint day.

Figure 34:
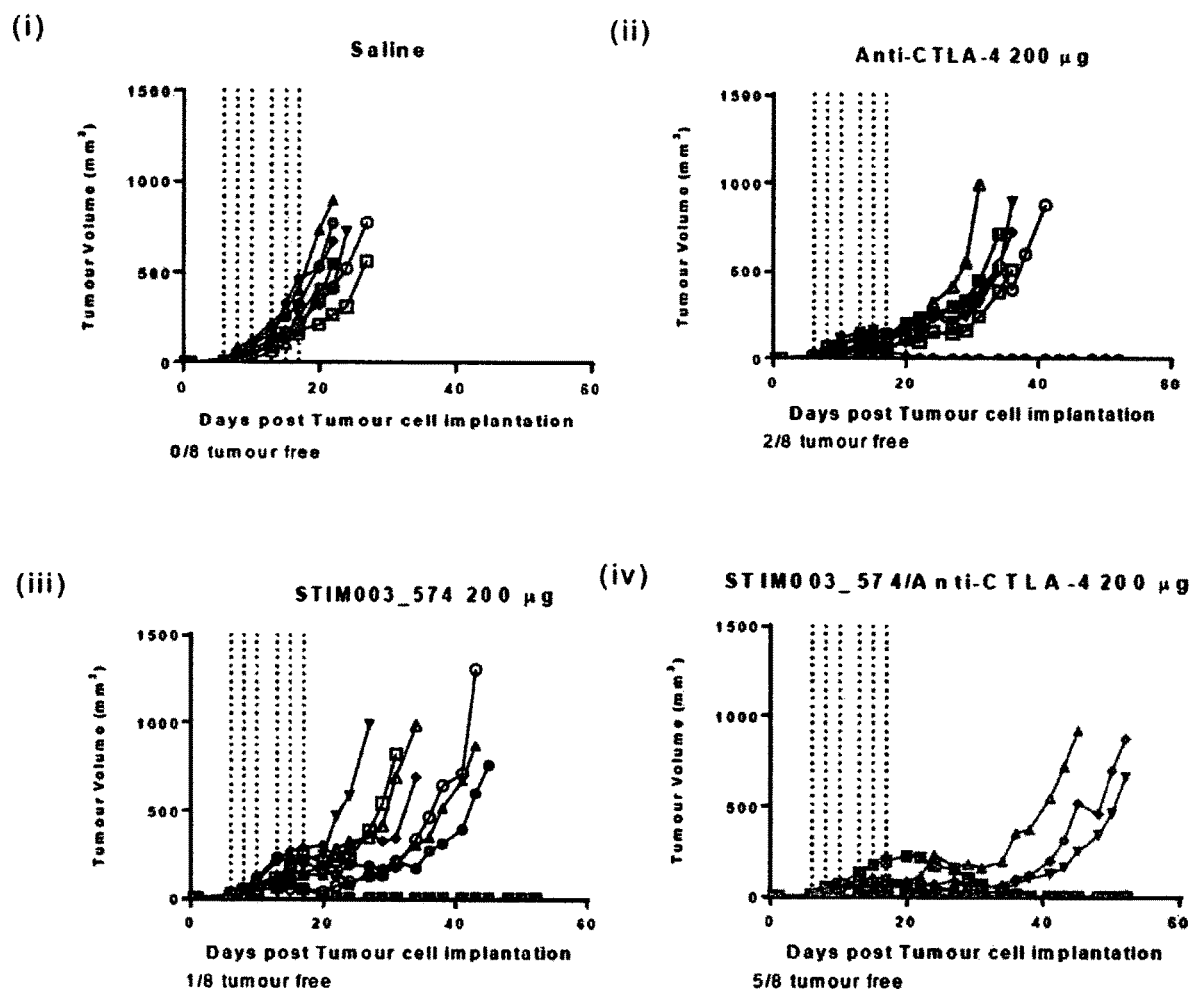
FIG. 34 Progression of tumour volume over time in mice treated with (i) saline, (ii) anti-CTLA-4 antibody 9D9, (iii) anti-ICOS/anti-PD-L1 bispecific antibody, (iv) combination of anti-CTLA-4 antibody 9D9 and anti-ICOS/anti-PD-L1 bispecific antibody. Dotted vertical lines indicate dosing days.
Figure 35:
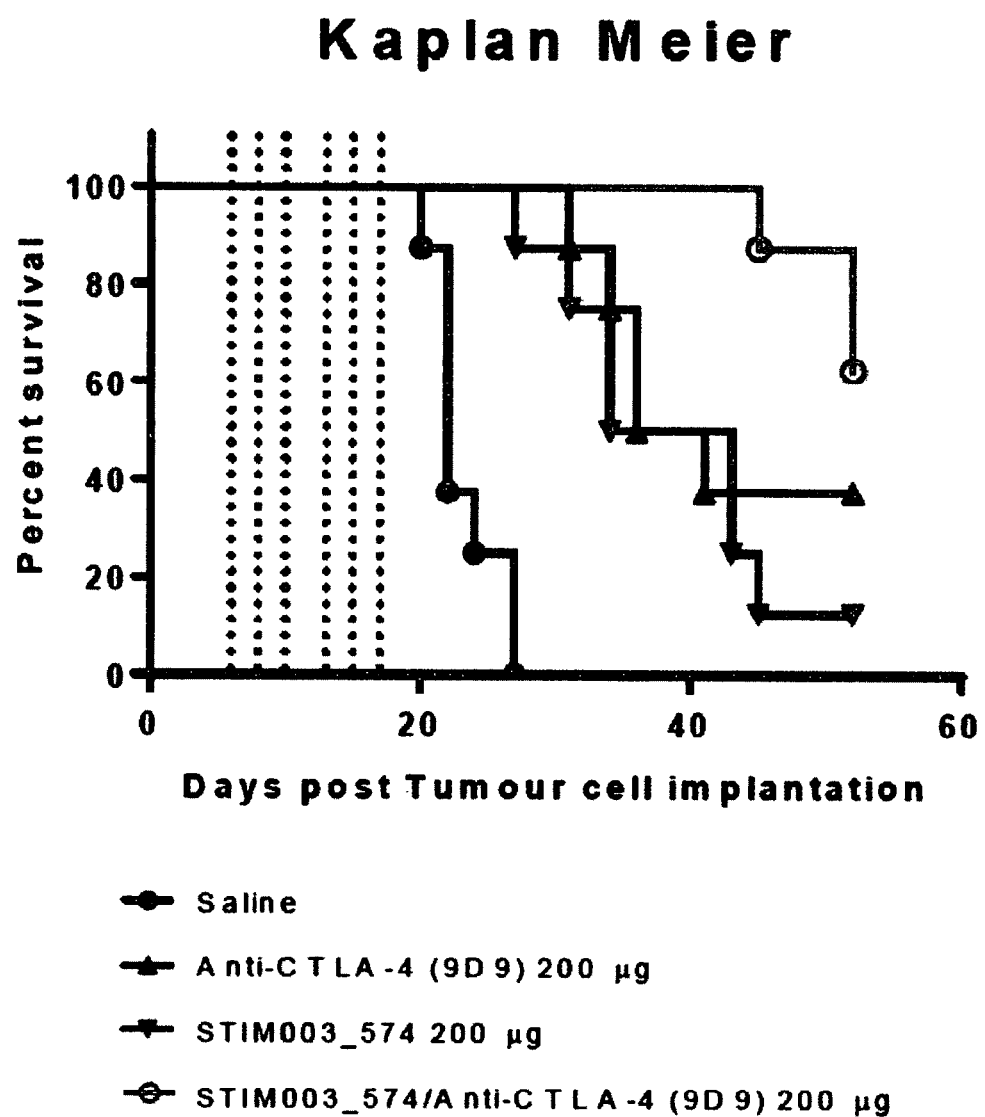
FIG. 35 Kaplan Meier plot showing superior efficacy of PD-L1/ICOS bispecific antibody combined with anti-CTLA-4 9D9 monospecific antibody, compared with either the bispecific or monospecific antibody administered alone in a CT26 tumour study.

The synergy observed with the combination of the anti-ICOS/anti-PD-L1 bispecific antibody with anti-CTLA4 was reproduced using another antibody, 9D9. This antibody has depletion potential and is therefore considered to be a close surrogate of the FDA-approved anti-CTLA-4 antibody ipilimimumab. In this further study, groups of 8 CT26 tumour-bearing mice were treated with (i) saline (negative control), (ii) 200 µg anti-CTLA-4 antibody 9D9, (iii) 200 µg STIM003_574 or (iv) 200 µg STIM003_574 and 200 µg anti-CTLA-4 9D9. In the saline control group, tumours grew rapidly in all 8 mice until the humane endpoint was reached, with no mice surviving to day 30 after tumour cell implantation. In the 9D9 anti-CTLA-4 antibody treated group, tumour growth was slower relative to control, and 2 of 8 mice remained tumour free until the study endpoint. In the STIM003_574 treated group, tumour growth was also slower relative to control, and 1 of 8 mice remained tumour free until the study endpoint. A stronger tumour growth delay and anti-tumour effect was observed in the mice who received both STIM003_574 and anti-CTLA-4. Tumour growth was suppressed in all 8 mice, and 5 of 8 mice had no detectable tumour at the end of the study. FIG. 34. Survival was extended, and overall survival was higher, in the combination therapy group compared with the group that received anti-CTLA-4 or STIM003_574 alone. FIG. 35.

Example 18 Discovery and Characterisation of PD-L1 Binding Fcab

The anti-human PD-L1 Fcab included in the mAb2 molecules described in the preceding Examples was originally sourced through selection and screening of naïve Fcab phage libraries. Naïve Fcabs were further optimised for affinity and functionality in three rounds of affinity maturation. Binding affinities, cell binding, SEC-HPLC and activity in T cell activation assays, were the main assays used for screening.

Naïve selections on human PD-L1 led to the isolation of FS17-33, which binds specifically to cell-surface human PD-L1 and has blocking activity towards both PD-L1/PD-1 and PD-L1/CD80. This clone was subjected to three rounds of affinity maturation. Whereas the first round moderately increased affinity and blocking activity, the second round resulted in clones with high affinity and functional activity due to the engagement of the CD loop. In the third mutagenesis round a sequence liability was removed. A resulting clone FS17-33-289 was fully characterised and shown to bind human PD-L1 with low nanomolar affinities. This molecule was found to be cross-reactive for binding PD-L1 from cynomolgus monkey, but not from mouse. It showed activity in three different T cell activation assays that matched benchmark mAbs. Biophysical characterisation indicated that the lead Fcab was stable.

In summary, the naïve selections and subsequent affinity maturations for the FS17 project identified an anti-human PD-L1 Fcab that met all criteria in terms of affinity, functionality and biophysical characteristics, and was considered to represent an active and stable protein likely to have success in the clinic.

Naïve Phage Selections 30 unique clones were identified and subcloned into a *Pichia pastoris* expression vector (pPICzα, Invitrogen) for soluble expression. Soluble Fcab proteins were then analysed in an ELISA-based Receptor Binding Assay (RBA) to assess their ability to block the PD-L1:PD-1 interaction. In these assays, the ability of Fcabs to inhibit the binding of biotinylated hPD-L1 to immobilised hPD-1 or hCD80 was tested. Of the 30 clones tested, three clones, FS17-19, 26 and 33, showed potent PD-L1:PD-1 blocking activity.

FS17-33 showed potent PD-L1:PD-1 as well as PD-L1:CD80 blocking activity in ELISA-based RBAs. The activity of FS17-33 was about 15-20 fold off benchmark. The activity of FS17-33 to inhibit PD-L1/PD-1 interaction was also confirmed in a cell-based RBA To test the binding specificity, FS17-33 binding was analysed at 1 µM on a panel of HEK293 cells overexpressing immune checkpoint regulators. FS17-33 bound specifically to cell-surface human PD-L1 and not to human PD-1, human CD80 or mouse PD-L1 and mouse CD80.

Affinity Maturation 1—Parsimonious Mutagenesis of Binding Loops

To increase the affinity of FS17-33, a parsimonious randomisation strategy was employed. In this strategy one single amino acid residue is randomised at a time, creating mini-libraries that can be scanned for improved affinity. The libraries were made with low-redundancy NNK codons designed to represent all possible AA in the position of interest. As FS17-33 contains five mutations in the AB and seven in EF loop compared to wild type Fc, 12 libraries were generated and expressed in HEK293 in a 96-well format. Supernatants were analysed for Fcab expression levels as well as blocking activity in PD-L1: PD-1 RBAs. The activity was compared to a FS17-33 dose-response curve used as a threshold for selection of improved mutants. Certain positions did not produce any improved blocking Fcabs indicating that the amino acids in these positions are crucial for the binding specificity. On the contrary, substitutions at other positions produced a number of improved Fcabs with sequence diversity.

27 improved Fcabs were re-expressed and re-analysed as purified protein. The top four AB mutants were subsequently shuffled with the top three EF mutants. These clones were ranked based on activity in cell-based RBA, cell binding, SEC-HPLC profile and activity in the T cell activation assay.

The blocking activity of the shuffled FS17-33 clones was assessed in cell-based RBAs using HEK293 overexpressing human PD-L1 and biotinylated hPD-1-Fc. Several FS17-33 derived mutants showed improved blocking activity compared to parental clone, albeit not matching benchmark mAb.

To test the binding to cell-surface human and cyno PD-L1, the top clones from replicate RBA assays were tested for binding to HEK293 overexpressing human or cyno PD-L1. All Fcabs showed dose-dependent binding to hPD-L1 with EC50 values around 5-10 nM. Binding to cell-bound cyno PD-L1 was of lower affinity (EC50 values around 100-200 nM). The affinity of Benchmark S1 was similar for both human and cyno PD-L1 indicating that HEK293: PD-1 and HEK293: cyno PD-L1 have similar levels of overexpression.

The functional activity of the FS17-33 derived clones was tested in a T cell activation assay. In this assay, T cells expressing PD-1 protein were used as effector cells and antigen presenting cells (APC) expressing human PD-L1 were used as target cells. The T cells were stimulated with the APCs in the presence or absence of FS17-33 derived Fcabs. After 24 hr incubation, the T cell reaction supernatants were harvested and assessed for IL-2 secretion by ELISA. The functional activity of the FS17-33 Fcabs was very weak compared to one of the benchmark mAb (EC50 of benchmarks are around 0.3 nM). The Fcabs were therefore screened at concentrations up to 2 µM to allow selection of the best clones.

Binding and activity data revealed a pool of Fcabs with similar activity. SEC-HPLC analysis was performed to analyse the percentage of monomer. FS17-33 derived Fcabs showed a 100% monomeric profile.

In conclusion the parsimonious mutagenesis strategy of parental FS17-33 Fcab has led to the identification of multiple clones with increased PD-L1: PD-1 blocking activity. The anti-human PD-L1 binding FS17-33 derived Fcabs are cross-reactive to cynoPD-L1 albeit with lower affinity. The activity of the FS17-33 lineage in the T cell activation assay was very weak compared to benchmark mAbs. This data seems inconsistent with the blocking data but could be explained by blocking assay parameters such as assay window and high levels of human PD-L1 on HEK293: PD-L1 causing avidity. More substantial randomisation of the binding loops is required to accomplish higher gains in affinity and functional activity. FS17-33-37 was selected as the parent for these affinity maturations.

Affinity Maturation 2—Hard Randomisation of Binding Loops

FS17-33-37 is a human-specific PD-L1 binding Fcab that is able to block the interaction between PD-L1:PD-1 and PD-L1:CD80 in vitro. The activity in T cell activation assay is weak and affinity maturation is therefore required. To this end the AB, CD and EF loops of FS17-33-37 were randomised and selections performed using the yeast platform. Enrichment for binders was observed during the selections and screening in the display format has identified anti-human FS17-33-37 derived Fcabs with superior binding to PD-L1. Sequence diversity was limited in the AB and EF loops while the CD loop showed high diversity with an emerging lineage. These clones were subcloned into the pTT5 mammalian expression vector for characterisation of the soluble protein. To screen the clones from the three selections, the supernatants from HEK293 expressed with Fcabs were flowed over a Biacore chip coated with hPD-L1-Fc. The off-rates were then compared to the parental clone. EF mutant clones showed little to no improvement and only a few clones from the AB selections showed improvement in the off-rate. However, all of the clones from the CD selections showed significant improvement in the off-rate. The best clones were then tested in the functional assay to correlate the improvement in off-rate with activity.

The best clone tested in the T-cell activation assay showed good improvement in activity compared to the parental clone, but was still considerably less active than benchmark mAbs. For this reason the clones with mutations in a single loop were deprioritised and it was decided to make a new shuffle library from the outputs of all three libraries.

The shuffled library was generated as described in the methods and to increase the diversity an error prone mutagenesis across the entire CH3 was added to the shuffle library. To identify the strongest binders and to minimise avidity, selections were performed with hPD-L1-His antigen biotinylated in-house. Since the biotinylation randomly occurs on lysines throughout the protein that could interfere with binding of the Fcabs, selections were also performed in parallel with hPD-L1-Fc-Avi antigen.

In each round the concentration was dropped and in the final round a second staining procedure was performed in which the antigen is placed in competition with non-biotinylated antigen to select clones with the best off-rates. An anti-CH2 antibody was included in all of the selections with the hPD-L1-His antigen as a marker for expression and proper folding of the Fcab. Since the hPD-L1-Fc antigen will also bind this antibody, it cannot be included as a co-stain during selections. In this case expression is marked by the anti-express antibody (Invitrogen) and an additional round is included to sort the clones with high anti-CH2 binding with the aim to remove improperly folded Fcabs. Both selections showed strong enrichment for binding above a parental clone selected from the individual loop selections.

Sequence analysis of the outputs from each round showed that the AB loop had converged to a single sequence not previously identified and the EF sequence was primarily parental. The CD loop showed good diversity with a strong consensus emerging. All of the outputs were then sub cloned into the pTT5 mammalian expression vector at the 10 mL scale. For the non-competition outputs, clones were first expressed at 1 mL to screen based on Biacore off-rate and single point T cell activation assay data. Positives were re-expressed at the 10 mL scale. In total 52 clones were expressed at the 10 mL expression scale and screened based on biophysical properties and full titration in the T cell activation assay. This was performed in two batches, the first batch contained clones that were from the competition outputs and did not need a primary screen at 1 mL. From this batch, the best clones were 10 to 30-fold off the benchmark mAbs in functional activity and exhibited favourable biophysical properties.

The hard randomisation of the loops was successful in improving the functional activity of clone FS17-33-37. Most of the gains in affinity came from mutations in the CD and AB loops. The best clones from this campaign exhibit functional activity that matches benchmark mAbs in the T-cell activation assay. These clones contain a methionine in the EF loop which was present in the parental clone FS17-33-37.

Affinity Maturation 3—Parsimonious Mutagenesis of Methionine

To remove the methionine from the EF loop of the lead Fcabs, a parsimonious mutagenesis maturation strategy was initiated. At the methionine amino acid position in the EF loop, the sequence identity was randomised and all of the amino acid substitutions that did not introduce sequence liabilities were tested for binding, SEC profile and functional activity.

Mutations M419L was able to remove the methionine from the EF loop without any loss in activity. This mutation generated clone FS17-33-289.

Initial Characterisation of PD-L1 Fcab

Fcab binding affinity towards monomeric human and cyno PD-L1-His was determined using Biacore by immobilising the Fcab or mAb using Protein A capture and measuring the binding to PD-L1. The Fcabs bound to monomeric human PD-L1 with low nanomolar affinity and binding to cyno PD-L1 was within 2-fold of the binding to human PD-L1.

To determine whether the Fcabs specifically bind to cell-surface PD-L1, Fcab binding to HEK293 control cells or HEK293 cells overexpressing either human or cyno PD-L1 was assessed. Consistent with the Biacore binding, FS17-33-289 showed specific binding to cell-surface human and cyno PD-L1.

The ability of the anti-human PD-L1 binding Fcab to block the PD-1/PD-L1 as well as the CD80/PD-L1 interaction was tested in cell-based blocking assays. The data showed that FS17-33-289 efficiently blocked both the PD-1/PD-L1 and the CD80/PD-L1 interaction in vitro.

Inhibition of PD-1/PD-L1 and CD80/PD-L1 interaction relieves the co-inhibitory signals after T cell activation. The functional activity of the anti-human PD-L1 binding Fcabs was first tested in the previously described T cell activation assay using a T cell hybridoma cell line and APCs overexpressing human PD-L1. FS17-33-289 was active in this assay, and activity was further confirmed in a Staphylococcal Enterotoxin B (SEB) assay and a Mixed Leukocyte Reaction (MLR) assay using human PBMCs.

The ability of the anti-human PD-L1 binding Fcabs to bind to Protein A was determined using the Octet by assessing the binding of purified FS17-33-289 and wild type Fc protein to Protein A tips. Fcab showed similar binding to Protein A as wild type Fc.

The thermal stability of the anti-human PD-L1 Fcab was analysed by differential scanning calorimetry (DCS). A DSC thermogram of wild type Fc was used to represent the unfolding of the CH2 domain at 71° C. and CH3 domain at 83° C. domain, respectively. DSC analysis of the anti-human PD-L1 binding Fcab gave rise to a single melting transition, as is typically seen in Fcabs upon modification of the AB, CD and EF loops. The melting temperature differential of the Fcab compared to wild type Fc CH2 domain was within 5° C. and compared to the wild type Fc CH3 domain it was about 16° C.

In order to test Fcab stability, FS17-33-289 protein was incubated for 7 days in 90% serum at 37° C. Control samples were either kept at 4° C. or incubated in serum before adding to the assay ('0 day serum'). The activity was subsequently analysed in the T cell activation assay. Activity of the Fcabs incubated in serum for 7 days was equivalent to the control samples as well as to benchmark.

Materials & Methods

Naïve Phage Selections

Four Fcab phage libraries, PP1, PP2 PP4 and 5, were used for human naïve selections. For each library, three rounds of selections were performed using a combination of non-biotinylated and biotinylated hPD-L1-Fc antigens as wells as HEK293 cells overexpressing human PD-L1. For the recombinant antigen selections the beads used were alternated between streptavidin and neutravidin to avoid selecting phage that bound to either of those proteins. To deplete potential Fc binders from the input population a 20-fold excess of non-biotinylated recombinant human Fc protein was used. For the cell selections, control HEK293 cells were used for the deselection of non-specific cell binders.

Fcab Cloning and Expression

Phage or yeast pellets of individual clones were lysed and the CH3 region amplified by PCR before cloning into the pTT5 expression vector (National Research Council of Canada, NRC) engineered with an effector-less CH2 domain (LALA mutation). Expi293F™ cells from Invitrogen™ were grown according to the manufacturer's specifications and used for transfections at a cell density of $2 \times 10^6$ cells/mL. Transfections were performed using Expifectamine™ combined with the purified DNA in Optimem™ and added to 1 mL cell cultures for screening or 20 mL for protein characterisation. The cells were cultured for 5 days, followed by centrifugation to separate the cells from the supernatant. For screening assays, cell culture supernatants were collected and Fcab expression was titered by binding to protein-A tips using the Octet. Fcab concentrations in the supernatant ranged from 30 to 700 µg/ml. Aliquots of supernatant were then buffer exchanged using a PD Multi-Trap G-25 in PBS to measure antigen binding or in DMEM media for further characterisation. During the naïve selection campaigns Fcabs were initially expressed using the *Pichia pastoris*. To this end, the Fcabs were cloned into pPICzα and expressed exactly as described by the manufacturer (Invitrogen, *Pichia* expression kit).

Affinity Maturation Library Generation

For affinity maturation, Fcabs from prior campaigns were selected based on their activity in the functional D011 assay, SEC-HPLC profiles (>80% monomeric) and sequence diversity. To reduce the presence of parental clones in the libraries, wild type Fc sequences were restored in the AB and EF loops before mutagenesis of the respective loop. Full diversification of the AB, CD or EF loops was achieved by mutagenesis PCR. Library sizes covered the theoretical size 2 to 500-fold, except for the EF libraries in which the diversity is not covered. Sequence diversity was verified for all the libraries.

Loop Shuffle and Error Prone Yeast Mini Library Generation

The outputs from phage that showed the best off-rates and highest percentage of binders were used to create a shuffled library with error prone mutagenesis randomisation. The individual AB, CD, and EF loops were isolated, amplified via PCR and assembled randomly. Shuffled DNA fragments were subsequently amplified using the Gene Morph II random mutagenesis kit (Agilent) aiming for one to two mutations per CH3 domain. The resulting DNA was transformed into the yeast pYD1 vector (Invitrogen) containing the CH2 domain to produce an Fcab mini-library for yeast selections.

Yeast Affinity Maturation Selections

Yeast affinity maturation libraries were subjected to two to four rounds of selections using biotinylated hPD-L1-His protein. In each round of selection, the library as well as the parental clone were incubated with biotinylated antigen and binders were separated from non-binders by fluorescent cell sorting (FACS). Clones with improved binding were selected by gating higher fluorescent intensity cells those of the parental clone. Antigen concentrations were dropped in consecutive rounds to increase the stringency of the selection. In the final selection round an off-rate step was included which involved incubating the sample for several hours at room temperature in the presence of excess non-biotinylated antigen.

Subcloning from Yeast

Individual clones or outputs from selections were subcloned into the pTT5 mammalian expression vector (National Research Council of Canada, NRC) to produce soluble protein for screening and characterisation. DNA encoding the Fcab CH3 domain was amplified by PCR directly from phage glycerol stocks or from yeast that had been lysed using lyticase. Amplified DNA was subsequently digested and cloned into the pTT5 vector containing the IgG1 CH2 domain. For loop shuffling, the AB, CD and EF loops of selection outputs were combined by using a PCR to amplify either loop, followed by an assembly reaction to create the desired loop combinations. Shuffled DNA fragments were subsequently amplified using the Gene Morph II random mutagenesis kit (Agilent) aiming for one to two mutations per CH3 domain. The resulting DNA was transformed into the yeast pYD1 vector (Invitrogen) containing the CH2 domain to produce an Fcab mini-library for yeast selections.

Parsimonious Mutagenesis

Single point mutations were introduced in the AB and the EF loops of FS17-33-116 using the Quick-Change site directed mutagenesis kit (Agilent) and NNK randomisation primers. Mutations likely to introduce sequence liabilities were excluded. After transformation into *E. coli*, the DNA sequences of each mutant were verified and DNA was extracted for transient transfection into HEK293 cells.

Off-Rate Screening

HEK293 supernatants or purified proteins were screened for improvements in the off-rate using the Biacore 2000. Biotinylated hPD-L1-His was immobilised on streptavidin chips at approximately 216-228 RU for an expected Rmax of 100. Regeneration was achieved with one 30 sec. injection of 10 mM Glycine pH 2.5 followed by one 30 sec. injection of 10 mM NaOH. Purified proteins or HEK293 supernatants containing soluble Fcabs were injected over the chip at a flow rate of 30-50 µl/min for three minutes followed by a dissociation step at the same flow rate. Parental clones were included in the screening assay for comparison.

Fcab Purification

Fcabs expressed in 20 ml cultures were purified using MabSelect SuRe™ resin under endotoxin-free conditions. Eluted Fcab was buffer exchanged into PBS using and concentrated to at least 1 mg/ml using Amicon Ultra centrifugal units. Endotoxin levels were determined using Limulus Amebocyte Lysate Endochrome assay as described by the manufacturer (Endosafe kit, Charles River). Proteins with endotoxin levels<0.15 EU/mg were considered acceptable.

T Cell Activation Assay

Mouse antigen (Ovalbulmin)-specific T cells expressing murine PD-1 protein were used as effector cells and mouse antigen presenting cells (APC) expressing hPD-L1 were used as target cells. The T cells were stimulated with the APCs in the presence or absence of anti-hPD-L1 Fcab or anti-hPD-L1 benchmark antibodies at various concentrations and ovalbumin peptide. In the assay reaction, anti-hPD-L1 Fcabs were added either as purified protein or as HEK293 supernatant. After 24 hr incubation, the T cell reaction supernatants were harvested and assessed for IL-2 secretion by ELISA.

Mixed Lymphocyte Reaction (MLR) Assay

The MLR is an allogeneic reaction. Expanded CD4+ T cells from donor A are used as effector cells while immature dendritic cells (iDCs) from donor B are the APCs. The donor mismatch causes an immune response which results in activation of the TCR and release of IFNγ. After several days, increasing expression of hPD-L1 on the APCs with hPD-1 on the T cells inhibits IFNγ production. The addition of anti-human PD-L1 specific Fcabs blocks the interaction of hPD-L1 with hPD-1, releasing hPD-1 inhibition, and allowing IFNγ production. In this assay, Fcabs (and controls) are incubated with $1\times10^5$ CD4+ T cells and $1\times10^4$ iDCs per well for 5 days. The supernatants are then harvested and assessed for hIFNγ secretion by ELISA.

Staphylococcal Enterotoxin (SEB) Assay

In this assay expanded CD4+ T cells and iDCs from the same donor are mixed. SEB acts as a superantigen, being presented by MHC class II on the iDCs to the TCR on the T cells. As in the MLR, hPD-L1 on the iDCs interacts with PD-1 on the T cells, blocking IFNγ production. With the addition of anti-human PD-L1 Fcabs the block is released and IFNγ produced. Fcabs (and controls) are incubated with 1×10⁵ CD4+ T cells and 1×10⁴ iDCs per well with 0.1 ng/ml SEB for 4 days. The supernatants are then harvested and assessed for hIFNγ secretion by ELISA.

SEC-HPLC

SEC-HPLC experiments were performed on an Agilent 1100 series HPLC with a Zorbax GF-250 column (Agilent). The flow rate for these experiments was 1 ml/min and the mobile phase was 200 mM sodium phosphate, 400 mM NaCl, 15% isopropanol, pH 6.8. Sample concentrations were 0.5-1 mg/ml in PBS buffer.

Affinity Analysis

The affinity of the Fcabs was measured using the Biacore T200. Fcabs were captured using a Protein A immobilised chip. Human PD-L1-His binding was assessed using flow rates of 75 μl/min. Regeneration was achieved with one 30 sec. injection of 10 mM glycine pH 2.0. Curves were fit using the 1:1 model in the T200 evaluation software with Rmax set to local and RI set to 0.

Cell Binding

Cell binding assays were performed by incubating Fcabs or mAb proteins with either control HEK293 or HEK293 overexpressing hPD-L1 or cyno PD-L1 cells for 1 hour at 4° C. Fcab/mAb binding was subsequently detected using an anti-human Fc 488 pre-labeled detection antibody. Fluorescent signal intensities were measured using the FACS Canto.

Protein A Binding

Fcabs were serially diluted 1:2 in kinetics buffer starting from 2 μM in 1× kinetics buffer and assayed for binding to Protein A tips in the Octet (Forte Bio). All curves were subtracted from a reference well and grouped based on the Fcab being assayed.

Cell-Based Blocking Assays

The blocking activity of the Fcabs on both hPD-1/hPD-L1 and hPD-L1/hCD80 interactions was tested in cell-based Receptor Binding Assays (RBA). In brief, biotinylated hPD-L1-Fc-Avi at 1 μg/ml was incubated for 1 hour with titrating concentrations of Fcabs ranging from 400 nM to 3 μM. The mix was incubated for another hour with HEK293 cells overexpressing either hPD-1 or hCD80. The level of bound biotinylated hPD-L1-Fc-Avi on the cells was detected using streptavidin 647 and fluorescence levels were measured using the FACS Canto. Each point was performed in duplicate and experiments were performed twice. For the experiment performed with HEK293:hCD80 cells, the concentration of biotinylated hPD-L1-Fc-Avi used was 2 μg/ml.

DSC

Thermal stability measurements were performed using a Microcal VP-capillary differential scanning calorimeter (DSC). Samples were measured in PBS buffer (Lonza) at 0.2 mg/ml. The scan rate was set at 60° C./hr and data collected between 30° C. and 95° C. Data analysis was performed with Origin 7.0 software.

Sequences

TABLE S1

SEQ ID NOS: 1-342

| SEQ ID NO: | Name | Description | Sequence |
|---|---|---|---|
| 1 | Human PD-L1 | NCBI number: NP_054862.1 (ECD highlighted in BOLD, cytoplasmic domain underlined) | MRIFAVFIEMTYWHLLNAFTVTVPHDLYVVEYGSNMEIECKEPVEK QLDLAALIVYWEMEDKNITQFVHGEEDLEVQHSSYFtQRARLLKDQ LSLGNAALQITDVKLQDAGVYRCIIISYGGADYKRITVICVNAPYN KINQRILVVDPVTSEHELTCQAEGYPKAEVINTSSDHQVLSGKTTT TNSKREEKLENVTSTLRINTTTNEIFECTERRLDPEENHTAELVIP ELPLAHPPNERT<u>HLVILGAILLCLGVALTFIFRLRKGRMMDVKKCG IQDTNSKKQSDTHLEET</u> |
| 2 | Cyno PD-L1 | NCBI number: XP_014973154.1 (ECD highlighted in BOLD) | MGWSCIILELVATATGVHSMFTVTVPEDLYVVEYGSNMTIECKEPV EKQLDLTSLIVYWEMEDKNIIQFVHGEEDLEVQHSNYRQRAQLLED QLSLGNAALRITDVRLQDAGVERCMISYGGADYKRITVICVNAPYN KINQRILVVDPVTSEHELTCQAEGYPICAEVIWTSSDHQVLSGICT TTTNSKREEKLLNVTSTLRINTTANEIFECIERRLDPEENHTAELV IPELPLALPPNERT |
| 3 | Human PD-L1 His | Human PD-L1 ECD with C-terminal His tag | MRIFAVFIFMTYWHLLNAFTVTVPKDLYVVEYGSNMTIECKFPVEK QLDLAALIVYWEMEDKNIIQFVHGEEDLKVQHSSYRQRARLLKDQL SLGNAALQITDVKLQDAGVYRCMISYGGADYKRITVKVNAPYNKIN QRILVVDPVTSEHELTCQAEGYPKAEVIWTSSDHQVLSGKTTTTNS KREEKLFNVTSTLRINTTTNEIFYCTFRRLDPEENHTAELVIPELP LAHPPNERTHHHHHH |
| 4 | Human PD-L1 Fc | Human PD-L1 ECD with C-term Fc fusion (in bold) | MRIFAVFIFMTYWHLLNAFTVTVPKDLYVVEYGSNMTIECKFPVEK QLDLAALIVYWEMEDKNIIQFVHGEEDLKVQHSSYRQRARLLKDQL SLGNAALQITDVKLQDAGVYRCMISYGGADYKRITVKVNAPYNKIN QRILVVDPVTSEHELTCQAEGYPKAEVIWTSSDHQVLSGKTTTTNS KREEKLFNVTSTLRINTTTNEIFYCTFRRLDPEENHTAELVIPELP LAHPPNERTIEGREPKSCDKTHTCPPCPAPELLGGPSVFLFPPKPK DTLMISRTPEVICVVVDVSHEDPEVKFNWYVDGVEVHNAKTKPREE QYNSTYRVVSVLTVLHQDWLNGKEYECKVSNKALPAPIEKTISKAK GQPREPQVYTLPPSRDELTENQVSLTCLVKGFYPSDIAVEWESNGQ PENNYKTTPPVLDSDGSTFFLYSKLTVDESRWQQGNWSCSVMHEAL HNHYTQKSLSLSPGK |

TABLE S1-continued

SEQ ID NOS: 1-342

| SEQ ID NO: | Name | Description | Sequence |
|---|---|---|---|
| 5 | Cyno PD-L1 FLAG | Cynomolgus PD-L1 ECD with N-term FLAG tag | MGWSCIILFLVATATGVHSMFTVTVPKDLYVVEYGSNMTIECKFPV EKQLDLTSLIVYWEMEDKNIIQFVHGEEDLKVQHSNYRQRAQLLKD QLSLGNAALRITDVKLQDAGVYRCMISYGGADYKRITVKVNAPYNK INQRILVVDPVTSEHELTCQAEGYPKAEVIWTSSDHQVLSGKTTTT NSKREEKLLNVTSTLRINTTANEIFYCIFRRLDPEENHTAELVIPE LPLALPPNERTDYKDDDDK |
| 6 | Human PD-1 Fc derived | Human PD-1 full length sequence from cDNA as human Fc fusion | MGWSCIILFLVATATGVHSLDSPDRPWNPPTFSPALLVVTEGDNAT FTCSFSNTSESFVLNWYRMSPSNQTDKLAAFPEDRSQPGQDCRFRV TQLPNGRDFHMSVVRARRNDSGTYLCGAISLAPKAQIKESLRAELR VTERRAEVPTAHPSPSPRPAGQKLENLYFQGIEGRMDEPESCDKTH TCPPCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSRDELTKNQ VSLTCLVKGFYPSDIAVEWESNGQPENNYKTTPPVLDSDGSFFLYS KLTVDKSRWQQGNVFSCSVMHEALHNHYTQKSLSLSP |
| 7 | 84G09 - CDRH1 (IMGT) | Amino acid sequence of CDRH1 of 84G09 using IMGT | GFTFDDYA |
| 8 | 84G09 - CDRH2 (IMGT) | Amino acid sequence of CDRH2 of 84G09 using IMGT | ISWKSNII |
| 9 | 84G09 - CDRH3 (IMGT) | Amino acid sequence of CDRH3 of 84G09 using IMGT | ARDITGSGSYGWFDP |
| 10 | 84G09 - CDRH1 (Kabat) | Amino acid sequence of CDRH1 of 84G09 using Kabat | DYAMH |
| 11 | 84G09 - CDRH2 (Kabat) | Amino acid sequence of CDRH2 of 84G09 using Kabat | GISWKSNIIGYADSVKG |
| 12 | 84G09 - CDRH3 (Kabat) | Amino acid sequence of CDRH3 of 84G09 using Kabat | DITGSGSYGWFDP |
| 13 | 84G09 - Heavy chain variable region (mutations from germline are shown in bold letters) | Amino acid sequence of V$_H$ of 84G09 | EVQLVESGGGLVQPGRSLRLSCAASGFTFDDYAMHWVRQTPGKGLE WVSGISWKSNIIGYADSVKGRFTISRDNAKNSLYLQMNSLRAEDTA LYYCARDITGSGSYGWFDPWGQGTLVTVSS |
| 14 | 84G09 - Heavy chain variable region | Nucleic acid sequence of V$_H$ of 84G09 | CAaGAAAAAGCTTGCCGCCACCATGGAGTTTGGGCTGAGCTGGATT TTCCTTTTGGCTATTTTAAAAGGTGTCCAGTGTGAAGTACAATTGG TGGAGTCCGGGGGAGGCTTGGTACAGCCTGGCAGGTCCCTGAGACT CTCCTGTGCAGCCTCTGGATTCACCTTTGATGATTATGCCATGCAC TGGGTCCGACAAACTCCAGGGAAGGGCCTGGAGTGGGTCTCAGGTA TAAGTTGGAAGAGTAATATCATAGGCTATGCGGACTCTGTGAAGGG CCGATTCACCATCTCCAGAGACAACGCCAAGAACTCCCTGTATCTG CAAATGAACAGTCTGAGAGCTGAGGACACGGCCTTGTATTATTGTG CAAGAGATATAACGGGTTCGGGGAGTTATGGCTGGTTCGACCCCTG GGGCCAGGGAACCCTGGTCACCGTCTCCTCAGCCAAAACGACACCC CCATCTGTCTATCCACTGGCCCCTGAATCTGCTAAAACTCAGCCTC CG |
| 15 | 84G09 - full heavy chain sequence (mutations from germline are shown in bold letters) | Amino acid sequence of 84G09 heavy chain | EVQLVESGGGLVQPGRSLRLSCAASGFTFDDYAMHWVRQTPGKGLE WVSGISWKSNIIGYADSVKGRFTISRDNAKNSLYLQMNSLRAEDTA LYYCARDITGSGSYGWFDPWGQGTLVTVSSASTKGPSVFPLAPCSR STSESTAALGCLVKDYFPEPVTVSWNSGALTSGVHTFPAVLQSSGL YSLSSVVTVPSSSLGTKTYTCNVDHKPSNTKVDKRVESKYGPPCPP CPAPEFEGGPSVFLFPPKPKDTLMISRTPEVTCVVVDVSQEDPEVQ |

TABLE S1-continued

SEQ ID NOS: 1-342

| SEQ ID NO: | Name | Description | Sequence |
|---|---|---|---|
| | | | FNWYVDGVEVHNAKTKPREEQFNSTYRVVSVLTVLHQDWLNGKEYK CKVSNKGLPSSIEKTISKAKGQPREPQVYTLPPSQEEMTKNQVSLT CLVKGFYPSDIAVEWESNGQPENNYKTTPPVLDSDGSFFLYSRLTV DKSRWQEGNVFSCSVMHEALHNHYTQKSLSLSLGK |
| 16 | 84G09 - full heavy chain sequence | Nucleic acid sequence of 84G09 heavy chain | GAAGTGCAGCTGGTGGAATCTGGCGGCGGACTGGTGCAGCCTGGCA GATCCCTGAGACTGTCTTGTGCCGCCTCCGGCTTCACCTTCGACGA CTACGCTATGCACTGGGTGCGACAGACCCCTGGCAAGGGCCTGGAA TGGGTGTCCGGCATCTCCTGGAAGTCCAACATCATCGGCTACGCCG ACTCCGTGAAGGGCCGGTTCACCATCTCCCGGGACAACGCCAAGAA CTCCCTGTACCTGCAGATGAACAGCCTGCGGGCCGAGGACACCGCC CTGTACTACTGCGCCAGAGACATCACCGGCTCCGGCTCCTACGGAT GGTTCGATCCTTGGGGCCAGGGCACCCTCGTGACCGTGTCCTCTGC CAGCACCAAGGGCCCCTCTGTGTTCCCTCTGGCCCCTTCCAGCAAG TCCACCTCTGGCGGAACAGCCGCTCTGGGCTGCCTCGTGAAGGACT ACTTCCCCGAGCCTGTGACCGTGTCCTGGAACTCTGGCGCTCTGAC CAGCGGAGTGCACACCTTCCCTGCTGTGCTGCAGTCCTCCGGCCTG TACTCCCTGTCCTCCGTCGTGACCGTGCCTTCCAGCTCTCTGGGCA CCCAGACCTACATCTGCAACGTGAACCACAAGCCCTCCAACACCAA GGTGGACAAGAAGGTGGAACCCAAGTCCTGCGACAAGACCCACACC TGTCCCCCTTGTCCTGCCCCTGAACTGCTGGGCGGACCTTCCGTGT TCCTGTTCCCCCCAAAGCCCAAGGACACCCTGATGATCTCCCGGAC CCCCGAAGTGACCTGCGTGGTGGTGGATGTGTCCCACGAGGACCCT GAAGTGAAGTTCAATTGGTACGTGGACGGCGTGGAAGTGCACAACG CCAAGACCAAGCCTAGAGAGGAACAGTACAACTCCACCTACCGGGT GGTGTCCGTGCTGACCGTGCTGCACCAGGATTGGCTGAACGGCAAA GAGTACAAGTGCAAGGTGTCCAACAAGGCCCTGCCTGCCCCCATCG AAAAGACCATCTCCAAGGCCAAGGGCCAGCCCCGGGAACCCCAGGT GTACACACTGCCCCCTAGCAGGGACGAGCTGACCAAGAACCAGGTG TCCCTGACCTGTCTCGTGAAAGGCTTCTACCCCTCCGATATCGCCG TGGAATGGGAGTCCAACGGCCAGCCTGAGAACAACTACAAGACCAC CCCCCCTGTGCTGGACTCCGACGGCTCATTCTTCCTGTACAGCAAG CTGACAGTGGACAAGTCCCGGTGGCAGGAGGGCAACGTGTTCTCCT GCTCCGTGATGCACGAGGCCCTGCACAACCACTACACCCAGAAGTC CCTGTCCCTGAGCCCCGGCAAG |
| 17 | 84G09 - CDRL1 (IMGT) | Amino acid sequence of CDRL1 of 84G09 using IMGT | QSISSY |
| 18 | 84G09 - CDRL2 (IMGT) | Amino acid sequence of CDRL2 of 84G09 using IMGT | VAS |
| 19 | 84G09 - CDRL3 (IMGT) | Amino acid sequence of CDRL3 of 84G09 using IMGT | QQSYSNPIT |
| 20 | 84G09 - CDRL1 (Kabat) | Amino acid sequence of CDRL1 of 84G09 using Kabat | RASQSISSYLN |
| 21 | 84G09 - CDRL2 (Kabat) | Amino acid sequence of CDRL2 of 84G09 using Kabat | VASSLQS |
| 22 | 84G09 - CDRL3 (Kabat) | Amino acid sequence of CDRL3 of 84G09 using Kabat | QQSYSNPIT |
| 23 | 84G09 - Light chain variable region | Amino acid sequence of V_L of 84G09 | DIQMTQSPSSLSASVGDRVTITCRASQSISSYLNWYQQKPGKAPKP LIYVASSLQSGVPSSFSGSGSGTDFTLTISSLQPEDFATYYCQQSY SNPITFGQGTRLEIK |
| 24 | 84G09 - Light | Nucleic acid sequence of V_L of | GACATCCAGATGACCCAGTCTCCATCCTCCCTGTCTGCATCTGTAG GAGACAGAGTCACCATCACTTGCCGGGCAAGTCAGAGCATTAGCAG |

TABLE S1-continued

SEQ ID NOS: 1-342

| SEQ ID NO: | Name | Description | Sequence |
|---|---|---|---|
| | chain variable region | 84G09 | CTATTTAAATTGGTATCAGCAGAAACCAGGGAAAGCCCCTAAGCCC CTGATCTATGTTGCATCCAGTTTGCAAAGTGGGGTCCCATCAAGTT TCAGTGGCAGTGGATCTGGGACAGATTTCACTCTCACCATCAGCAG TCTGCAACCTGAAGATTTTGCAACTTACTACTGTCAACAGAGTTAC AGTAATCCGATCACCTTCGGCCAAGGGACACGACTGGAGATCAAA |
| 25 | 84G09 - full light chain sequence | Amino acid sequence of E4G09 light chain | DIQMTQSPSSLSASVGDRVTITCRASQSISSYLNWYQQKPGKAPKP LIYVASSLQSGVPSSFSGSGSGTDFTLTISSLQPEDFATYYCQQSY SNPITFGQGTRLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 26 | 84G09 - full light chain sequence | Nucleic acid sequence of 84G09 light chain | GACATCCAGATGACCCAGTCTCCATCCTCCCTGTCTGCATCTGTAG GAGACAGAGTCACCATCACTTGCCGGGCAAGTCAGAGCATTAGCAG CTATTTAAATTGGTATCAGCAGAAACCAGGGAAAGCCCCTAAGCCC CTGATCTATGTTGCATCCAGTTTGCAAAGTGGGGTCCCATCAAGTT TCAGTGGCAGTGGATCTGGGACAGATTTCACTCTCACCATCAGCAG TCTGCAACCTGAAGATTTTGCAACTTACTACTGTCAACAGAGTTAC AGTAATCCGATCACCTTCGGCCAAGGGACACGACTGGAGATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTCCAAGGCC GACTACGAGAAGCACAAGGTGTACGCCTGCGAAGTGACCCACCAGG GCCTGTCTAGCCCCGTGACCAAGTCTTTCAACCGGGGCGAGTGT |
| 27 | 1D05 - CDRH1 (IMGT) | Amino acid sequence of CDRH1 of 1D05 using IMGT | GFTFDDYA |
| 28 | 1D05 - CDRH2 (IMGT) | Amino acid sequence of CDRH2 of 1D05 using IMGT | ISWIRTGI |
| 29 | 1D05 - CDRH3 (IMGT) | Amino acid sequence of CDRH3 of 1D05 using IMGT | AKDMKGSGTYGGWFDT |
| 30 | 1D05 - CDRH1 (Kabat) | Amino acid sequence of CDRH1 of 1D05 using Kabat | DYAMH |
| 31 | 1D05 - CDRH2 (Kabat) | Amino acid sequence of CDRH2 of 1D05 using Kabat | GISWIRTGIGYADSVKG |
| 32 | 1D05 - CDRH3 (Kabat) | Amino acid sequence of CDRH3 of 1D05 using Kabat | DMKGSGTYGGWFDT |
| 33 | 1D05 - Heavy chain variable region letters) | Amino acid sequence of V$_H$ of 1D05 (mutations from germline are shown in bold | EVQLVESGGGLVQPGRSLRLSCAASGFTFDDYAMHWVRQVPGKGLE WVSGISWIRTGIGYADSVKGRFTIFRDNAKNSLYLQMNSLRAEDTA LYYCAKDMKGSGTYGGWFDTWGQGTLVTVSS |
| 34 | 1D05 - Heavy chain variable region | Nucleic acid sequence of V$_H$ of 1D05 | AAGCTTGCCGCCACCATGGAGTTTGGGCTGAGCTGGATTTTCCTTT TGGCTATTTTAAAAGGTGTCCAGTGTGAAGTGCAGCTGGTGGAGTC TGGGGGAGGCTTGGTGCAGCCTGGCAGGTCCCTGAGACTCTCCTGT GCAGCCTCTGGATTCACCTTTGATGATTATGCCATGCACTGGGTCC GGCAAGTTCCAGGGAAGGGCCTGGAATGGGTCTCAGGCATTAGTTG GATTCGTACTGGCATAGGCTATGCGGACTCTGTGAAGGGCCGATTC ACCATTTTCAGAGACAACGCCAAGAATTCCCTGTATCTGCAAATGA ACAGTCTGAGAGCTGAGGACACGGCCTTGTATTACTGTGCAAAGGA TATGAAGGGTTCGGGGACTTATGGGGGTGGTTCGACACCTGGGGC CAGGGAACCCTGGTCACCGTCTCCTCAGCCAAAACAACAGCCCCAT CGGTCTATCCACTGGCCCTGC |

TABLE S1-continued

SEQ ID NOS: 1-342

| SEQ ID NO: | Name | Description | Sequence |
|---|---|---|---|
| 35 | 1D05 - full heavy chain sequence | Amino acid sequence of 1D05 heavy chain | EVQLVESGGGLVQPGRSLRLSCAASGFTFDDYAMHWVRQVPGKGLE WVSGISWIRTGIGYADSVKGRFTIFRDNAKNSLYLQMNSLRAEDTA LYYCAKDMKGSGTYGGWFDTWGQGTLVTVSSASTKGPSVFPLAPCS RSTSESTAALGCLVKDYFPEPVTVSWNSGALTSGVHTFPAVLQSSG LYSLSSVVTVPSSSLGTKTYTCNVDHKPSNTKVDKRVESKYGPPCP PCPAPEFEGGPSVFLFPPKPKDTLMISRTPEVTCVVVDVSQEDPEV QFNWYVDGVEVHNAKTKPREEQFNSTYRVVSVLTVLHQDWLNGKEY KCKVSNKGLPSSIEKTISKAKGQPREPQVYTLPPSQEEMTKNQVSL TCLVKGFYPSDIAVEWESNGQPENNYKTTPPVLDSDGSFFLYSRLT VDKSRWQEGNVFSCSVMHEALHNHYTQKSLSLSLGK |
| 36 | 1D05 - full heavy chain sequence | Nucleic acid sequence of 1D05 heavy chain | GAAGTGCAGCTGGTGGAATCTGGCGGCGGACTGGTGCAGCCTGGCA GATCCCTGAGACTGTCTTGTGCCGCCTCCGGCTTCACCTTCGACGA CTACGCTATGCACTGGGTGCGACAGGTGCCAGGCAAGGGCCTGGAA TGGGTGTCCGGCATCTCTTGGATCCGGACCGGCATCGGCTACGCCG ACTCTGTGAAGGGCCGGTTCACCATCTTCCGGGACAACGCCAAGAA CTCCCTGTACCTGCAGATGAACAGCCTGCGGGCCGAGGACACCGCC CTGTACTACTGCGCCAAGGACATGAAGGGCTCCGGCACCTACGGCG GATGGTTCGATACTTGGGGCCAGGGCACCCTCGTGACCGTGTCCTC TGCCAGCACCAAGGGCCCCTCTGTGTTCCCTCTGGCCCCTTCCAGC AAGTCCACCTCTGGCGGAACAGCCGCTCTGGGCTGCCTCGTGAAGG ACTACTTCCCCGAGCCTGTGACCGTGTCCTGGAACTCTGGCGCTCT GACCAGCGGAGTGCACACCTTCCCTGCTGTGCTGCAGTCCTCCGGC CTGTACTCCCTGTCCTCCGTCGTGACCGTGCCTTCCAGCTCTCTGG GCACCCAGACCTACATCTGCAACGTGAACCACAAGCCCTCCAACAC CAAGGTGGACAAGAAGGTGGAACCCAAGTCCTGCGACAAGACCCAC ACCTGTCCCCCTTGTCCTGCCCCTGAACTGCTGGGCGGACCTTCCG TGTTCCTGTTCCCCCCAAAGCCCAAGGACACCCTGATGATCTCCCG GACCCCCGAAGTGACCTGCGTGGTGGTGGATGTGTCCCACGAGGAC CCTGAAGTGAAGTTCAATTGGTACGTGGACGGCGTGGAAGTGCACA ACGCCAAGACCAAGCCTAGAGAGGAACAGTACAACTCCACCTACCG GGTGGTGTCCGTGCTGACCGTGCTGCACCAGGATTGGCTGAACGGC AAAGAGTACAAGTGCAAGGTGTCCAACAAGGCCCTGCCTGCCCCCA TCGAAAAGACCATCTCCAAGGCCAAGGGCCAGCCCCGGGAACCCCA GGTGTACACACTGCCCCCTAGCAGGGACGAGCTGACCAAGAACCAG GTGTCCCTGACCTGTCTCGTGAAAGGCTTCTACCCCTCCGATATCG CCGTGGAATGGGAGTCCAACGGCCAGCCTGAGAACAACTACAAGAC CACCCCCCCTGTGCTGGACTCCGACGGCTCATTCTTCCTGTACAGC AAGCTGACAGTGGACAAGTCCCGGTGGCAGCAGGGCAACGTGTTCT CCTGCTCCGTGATGCACGAGGCCCTGCACAACCACTACACCCAGAA GTCCCTGTCCCTGAGCCCCGGCAAG |
| 37 | 1D05 - CDRL1 (IMGT) | Amino acid sequence of CDRL1 of 1D05 using IMGT | QSISSY |
| 38 | 1D05 - CDRL2 (IMGT) | Amino acid sequence of CDRL2 of 1D05 using IMGT | VAS |
| 39 | 1D05 - CDRL3 (IMGT) | Amino acid sequence of CDRL3 of 1D05 using IMGT | QQSYSTPIT |
| 40 | 1D05 - CDRL1 (Kabat) | Amino acid sequence of CDRL1 of 1D05 using Kabat | RASQSISSYLN |
| 41 | 1D05 - CDRL2 (Kabat) | Amino acid sequence of CDRL2 of 1D05 using Kabat | VASSLQS |
| 42 | 1D05 - CDRL3 (Kabat) | Amino acid sequence of CDRL3 of 1D05 using Kabat | QQSYSTPIT |

TABLE S1-continued

SEQ ID NOS: 1-342

| SEQ ID NO: | Name | Description | Sequence |
|---|---|---|---|
| 43 | 1D05 - Light chain variable region | Amino acid sequence of V_L of 1D05 (mutations from germline are shown in bold letters) | DIQMTQSPSSLSASVGDRVTITCRASQSISSYLNWYQQKPGKAPKL LIYVASSLQSGVPSRFSGSGSGTDFTLTISSLQPEDFATYYCQQSY STPITFGQGTRLEIK |
| 44 | 1D05 - Light chain variable region | Nucleic acid sequence of V_L of 1D05 | AAAGCTTGCCGCCACCATGAGGCTCCCTGCTCAGCTTCTGGGGCTC CTGCTACTCTGGCTCCGAGGTGCCAGATGTGACATCCAGATGACCC AGTCTCCATCCTCCCTGTCTGCATCTGTAGGAGACAGAGTCACCAT CACTTGCCGGGCAAGTCAGAGCATTAGCAGCTATTTAAATTGGTAT CAGCAGAAACCAGGGAAAGCCCCTAAACTCCTGATCTATGTTGCAT CCAGTTTGCAAAGTGGGGTCCCATCAAGGTTCAGTGGCAGTGGATC TGGGACAGATTTCACTCTCACTATCAGCAGTCTGCAACCTGAAGAT TTTGCAACTTACTACTGTCAACAGAGTTACAGTACCCCGATCACCT TCGGCCAAGGGACACGTCTGGAGATCAAACGTACGGATGCTGCACC AACT |
| 45 | 1D05 - full light chain sequence | Amino acid sequence of 1D05 light chain | DIQMTQSPSSLSASVGDPVTITCRASQSISSYLNWYQQKPGKAPKL LIYVASSLQSGVPSRFSGSGSGTDFTLTISSLQPEDFATYYCQQSY STPITFGQGTRLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 46 | 1D05 - full light chain sequence | Nucleic acid sequence of 1D05 light chain | GACATCCAGATGACCCAGTCCCCCTCCAGCCTGTCTGCTTCCGTGG GCGACAGAGTGACCATCACCTGTCGGGCCTCCCAGTCCATCTCCTC CTACCTGAACTGGTATCAGCAGAAGCCCGGCAAGGCCCCCAAGCTG CTGATCTACGTGGCCAGCTCTCTGCAGTCCGGCGTGCCCTCTAGAT TCTCCGGCTCTGGCTCTGGCACCGACTTTACCCTGACCATCAGCTC CCTGCAGCCCGAGGACTTCGCCACCTACTACTGCCAGCAGTCCTAC TCCACCCCTATCACCTTCGGCCAGGGCACCCGGCTGGAAATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTCCAAGGCC GACTACGAGAAGCACAAGGTGTACGCCTGCGAAGTGACCCACCAGG GCCTGTCTAGCCCCGTGACCAAGTCTTTCAACCGGGGCGAGTGT |
| 47 | Mutated 1D05 - HC mutant 1 | Amino acid sequence of 1D05 heavy chain with V to A back-mutation in framework region to germline highlighted with IgG1 disabled (LAGA) constant region | EVQLVESGGGLVQPGRSLRLSCAASGFTFDDYAMHWVRQAPGKGLE WVSGISWIRTGIGYADSVKGRFTIFRDNAKNSLYLQMNSLRAEDTA LYYCAKDMKGSGTYGGWFDTWGQGTLVTVSSASTKGPSVFPLAPCS RSTSESTAALGCLVKDYFPEPVTVSWNSGALTSGVHTFPAVLQSSG LYSLSSVVTVPSSSLGTKTYTCNVDHKPSNTKVDKRVESKYGPPCP PCPAPELAGAPSVFLFPPKPKDTLMISRTPEVTCVVVDVSQEDPEV QFNWYVDGVEVHNAKTKPREEQFNSTYRVVSVLTVLHQDWLNGKEY KCKVSNKGLPSSIEKTISKAKGQPREPQVYTLPPSQEEMTKNQVSL TCLVKGFYPSDIAVEWESNGQPENNYKTTPPVLDSDGSFFLYSRLT VDKSRWQEGNVFSCSVMHEALHNHYTQKSLSLSLGK |
| 48 | Mutated 1D05 - HC mutant 2 | Amino acid sequence of 1D05 heavy chain with F to S back-mutation in framework region to germline highlighted with IgG1 disabled (LAGA) constant region | EVQLVESGGGLVQPGRSLRLSCAASGFTFDDYAMHWVRQVPGKGLE WVSGISWIRTGIGYADSVKGRFTISRDNAKNSLYLQMNSLRAEDTA LYYCAKDMKGSGTYGGWFDTWGQGTLVTVSSASTKGPSVFPLAPCS RSTSESTAALGCLVKDYFPEPVTVSWNSGALTSGVHTFPAVLQSSG LYSLSSVVTVPSSSLGTKTYTCNVDHKPSNTKVDKRVESKYGPPCP PCPAPELAGAPSVFLFPPKPKDTLMISRTPEVTCVVVDVSQEDPEV QFNWYVDGVEVHNAKTKPREEQFNSTYRVVSVLTVLHQDWLNGKEY KCKVSNKGLPSSIEKTISKAKGQPREPQVYTLPPSQEEMTKNQVSL TCLVKGFYPSDIAVEWESNGQPENNYKTTPPVLDSDGSFFLYSRLT VDKSRWQEGNVFSCSVMHEALHNHYTQKSLSLSLGK |
| 49 | Mutated 1D05 - HC mutant 3 | Amino acid sequence of 1D05 heavy chain with ELLG to -PVA back-mutation in constant region to germline highlighted | EVQLVESGGGLVQPGRSLRLSCAASGFTFDDYAMHWVRQVPGKGLE WVSGISWIRTGIGYADSVKGRFTIFRDNAKNSLYLQMNSLRAEDTA LYYCAKDMKGSGTYGGWFDTWGQGTLVTVSSASTKGPSVFPLAPCS RSTSESTAALGCLVKDYFPEPVTVSWNSGALTSGVHTFPAVLQSSG LYSLSSVVTVPSSSLGTKTYTCNVDHKPSNTKVDKRVESKYGPPCP PCPAP-PVAGPSVFLFPPKPKDTLMISRTPEVTCVVVDVSQEDPEV QFNWYVDGVEVHNAKTKPREEQFNSTYRVVSVLTVLHQDWLNGKEY KCKVSNKGLPSSIEKTISKAKGQPREPQVYTLPPSQEEMTKNQVSL TCLVKGFYPSDIAVEWESNGQPENNYKTTPPVLDSDGSFFLYSRLT QEGNVFSCSVMHEALHNHYTQKSLSLSLGK |

TABLE S1-continued

SEQ ID NOS: 1-342

| SEQ ID NO: | Name | Description | Sequence |
|---|---|---|---|
| 50 | Mutated 1D05 - LC mutant 1 | Amino acid sequence of 1D05 kappa light chain with V to A back-mutation in CDRL2 to germline highlighted | DIQMTQSPSSLSASVGDRVTITCRASQSISSYLNWYQQKPGKAPKL LIYAASSLQSGVPSRFSGSGSGTDFTLTISSLQPEDFATYYCQQSY STPITFGQGTRLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 51 | Mutated 1D05 - LC mutant 2 | Amino acid sequence of 1D05 kappa light chain with L to F back-mutation in framework to germline highlighted | DIQMTQSPSSLSASVGDRVTITCRASQSISSYLNWYQQKPGKAPKL FIYVASSLQSGVPSRFSGSGSGTDFTLTISSLQPEDFATYYCQQSY STPITFGQGTRLEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 52 | 411B08 - CDRH1 (IMGT) | Amino acid sequence of CDRH1 of 411B08 using IMGT | GFTFSSYW |
| 53 | 411B08 - CDRH2 (IMGT) | Amino acid sequence of CDRH2 of 411B08 using IMGT | IKEDGSEK |
| 54 | 411B08 - CDRH3 (IMGT) | Amino acid sequence of CDRH3 of 411B08 using IMGT | ARNRLYSDFLDN |
| 55 | 411B08 - CDRH1 (Kabat) | Amino acid sequence of CDRH1 of 411B08 using Kabat | SYWMS |
| 56 | 411B08 - CDRH2 (Kabat) | Amino acid sequence of CDRH2 of 411B08 using Kabat | NIKEDGSEKYYVDSVKG |
| 57 | 4111308 - CDRH3 (Kabat) | Amino acid sequence of CDRH3 of 411B08 using Kabat | NRLYSDFLDN |
| 58 | 411B08 - Heavy chain variable region | Amino acid sequence of $V_H$ of 411B08 | EVQLVESGGGLVQPGGSLRLSCAASGFTFSSYWMSWVRQAPGKGLE WVANIKEDGSEKYYVDSVKGRFTISRDNAKNSLYLQMNSLRAEDTS VYYCARNRLYSDFLDNWGQGTLVTVSS |
| 59 | 411B08 - Heavy chain variable region | Nucleic acid sequence of $V_H$ of 411B08 | GAGGTGCAGCTGGTGGAGTCTGGGGGAGGCTTGGTCCAGCCTGGGG GGTCCCTGAGACTCTCCTGTGCAGCCTCTGGATTCACGTTTAGTAG CTATTGGATGAGTTGGGTCCGCCAGGCTCCAGGGAAGGGGCTGGAG TGGGTGGCCAACATCAAAGAAGATGGAAGTGAGAAATACTATGTCG ACTCTGTGAAGGGCCGATTCACCATCTCCAGAGACAACGCCAAGAA CTCACTGTATCTGCAAATGAACAGCCTGAGAGCCGAGGACACGTCT GTGTATTACTGTGCGAGAAATCGACTCTACAGTGACTTCCTTGACA ACTGGGGCCAGGGAACCCTGGTCACCGTCTCCTCAG |
| 60 | 411B08 - full heavy chain sequence | Amino acid sequence of 4111308 heavy chain | EVQLVESGGGLVQPGGSLRLSCAASGFTFSSYWMSWVRQAPGKGLE WVANIKEDGSEKYYVDSVKGRFTISRDNAKNSLYLQMNSLRAEDTS VYYCARNRLYSDFLDNWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPP CPAPELLGGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPAPIEKTISKAKGQPREPQVYTLPPSRDELTKNQVSLT CLVKGFYPSDIAVEWESNGQPENNYKTTPPVLDSDGSFFLYSKLTV DKSRWQQGNVFSCSVMHEALHNHYTQKSLSLSPGK |

TABLE S1-continued

SEQ ID NOS: 1-342

| SEQ ID NO: | Name | Description | Sequence |
|---|---|---|---|
| 61 | 411B08 - full heavy chain sequence | Nucleic acid sequence of 411B08 heavy chain | GAGGTGCAGCTGGTGGAGTCTGGGGGAGGCTTGGTCCAGCCTGGGG GGTCCCTGAGACTCTCCTGTGCAGCCTCTGGATTCACGTTTAGTAG CTATTGGATGAGTTGGGTCCGCCAGGCTCCAGGGAAGGGGCTGGAG TGGGTGGCCAACATCAAAGAAGATGGAAGTGAGAAATACTATGTCG ACTCTGTGAAGGGCCGATTCACCATCTCCAGAGACAACGCCAAGAA CTCACTGTATCTGCAAATGAACAGCCTGAGAGCCGAGGACACGTCT GTGTATTACTGTGCGAGAAATCGACTCTACAGTGACTTCCTTGACA ACTGGGGCCAGGGAACCCTGGTCACCGTCTCCTCAGCCAGCACCAA GGGCCCCTCTGTGTTCCCTCTGGCCCCTTCCAGCAAGTCCACCTCT GGCGGAACAGCCGCTCTGGGCTGCCTCGTGAAGGACTACTTCCCCG AGCCTGTGACCGTGTCCTGGAACTCTGGCGCTCTGACCAGCGGAGT GCACACCTTCCCTGCTGTGCTGCAGTCCTCCGGCCTGTACTCCCTG TCCTCCGTCGTGACCGTGCCTTCCAGCTCTCTGGGCACCCAGACCT ACATCTGCAACGTGAACCACAAGCCCTCCAACACCAAGGTGGACAA GAAGGTGGAACCCAAGTCCTGCGACAAGACCCACACCTGTCCCCCT TGTCCTGCCCCTGAACTGCTGGGCGGACCTTCCGTGTTCCTGTTCC CCCCAAAGCCCAAGGACACCCTGATGATCTCCCGGACCCCCGAAGT GACCTGCGTGGTGGTGGATGTGTCCCACGAGGACCCTGAAGTGAAG TTCAATTGGTACGTGGACGGCGTGGAAGTGCACAACGCCAAGACCA AGCCTAGAGAGGAACAGTACAACTCCACCTACCGGGTGGTGTCCGT GCTGACCGTGCTGCACCAGGATTGGCTGAACGGCAAGGAGTACAAG TGCAAGGTGTCCAACAAGGCCCTGCCTGCCCCCATCGAAAAGACCA TCTCCAAGGCCAAGGGCCAGCCCCGGGAACCCCAGGTGTACACACT GCCCCCTAGCAGGGACGAGCTGACCAAGAACCAGGTGTCCCTGACC TGTCTCGTGAAAGGCTTCTACCCCTCCGATATCGCCGTGGAATGGG AGTCCAACGGCCAGCCTGAGAACAACTACAAGACCACCCCCCCTGT GCTGGACTCCGACGGCTCATTCTTCCTGTACAGCAAGCTGACAGTG GACAAGTCCCGGTGGCAGCAGGGCAACGTGTTCTCCTGCTCCGTGA TGCACGAGGCCCTGCACAACCACTACACCCAGAAGTCCCTGTCCCT GAGCCCCGGCAAG |
| 62 | 411B08 - CDRL1 (IMGT) | Amino acid sequence of CDRL1 of 411B08 using IMGT | QGVSSW |
| 63 | 411B08 - CDRL2 (IMGT) | Amino acid sequence of CDRL2 of 411B08 using IMGT | GAS |
| 64 | 411B08 - CDRL3 (IMGT) | Amino acid sequence of CDRL3 of 411B08 using IMGT | QQANSIPFT |
| 65 | 411B08 - CDRL1 (Kabat) | Amino acid sequence of CDRL1 of 411B08 using Kabat | RASQGVSSWLA |
| 66 | 411B08 - CDRL2 (Kabat) | Amino acid sequence of CDRL2 of 411B08 using Kabat | GASSLQS |
| 67 | 411B08 - CDRL3 (Kabat) | Amino acid sequence of CDRL3 of 411B08 using Kabat | QQANSIPFT |
| 68 | 411B08 - Light chain variable region | Amino acid sequence of $V_L$ of 411B08 | DIQMTQSPSSVSASVGDRVTITCRASQGVSSWLAWYQQKSGKAPKL LIYGASSLQSGVPSRFSGSGSGTEFILTISSLQPEDFATYYCQQAN SIPFTFGPGTKVDIK |
| 69 | 411B08 - Light chain variable region | Nucleic acid sequence of $V_L$ of 411B08 | GACATCCAGATGACCCAGTCTCCATCTTCCGTGTCTGCATCTGTCG GAGACAGAGTCACCATCACTTGTCGGGCGAGTCAGGGTGTTAGCAG CTGGTTAGCCTGGTATCAGCAGAAATCAGGGAAAGCCCCTAAGCTC CTGATCTATGGTGCATCCAGTTTGCAAAGTGGGGTCCCATCAAGAT TCAGCGGCAGTGGATCTGGGACAGAGTTCATTCTCACCATCAGCAG CCTGCAGCCTGAAGATTTTGCAACTTACTATTGTCAACAGGCTAAC AGTATCCCATTCACTTTCGGCCCTGGGACCAAAGTGGATATCAAAC |

TABLE S1-continued

SEQ ID NOS: 1-342

| SEQ ID NO: | Name | Description | Sequence |
|---|---|---|---|
| 70 | 411B08 - full light chain sequence | Amino acid sequence of 411B08 light chain | DIQMTQSPSSVSASVGDRVTITCRASQGVSSWLAWYQQKSGKAPKL LIYGASSLQSGVPSRFSGSGSGTEFILTISSLQPEDFATYYCQQAN SIPFTFGPGTKVDIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 71 | 411B08 - full light chain sequence | Nucleic acid sequence of 411B08 light chain | GACATCCAGATGACCCAGTCTCCATCTTCCGTGTCTGCATCTGTCG GAGACAGAGTCACCATCACTTGTCGGGCGAGTCAGGGTGTTAGCAG CTGGTTAGCCTGGTATCAGCAGAAATCAGGGAAAGCCCCTAAGCTC CTGATCTATGGTGCATCCAGTTTGCAAAGTGGGGTCCCATCAAGAT TCAGCGGCAGTGGATCTGGGACAGAGTTCATTCTCACCATCAGCAG CCTGCAGCCTGAAGATTTTGCAACTTACTATTGTCAACAGGCTAAC AGTATCCCATTCACTTTCGGCCCTGGGACCAAAGTGGATATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTCCAAGGCC GACTACGAGAAGCACAAGGTGTACGCCTGCGAAGTGACCCACCAGG GCCTGTCTAGCCCCGTGACCAAGTCTTTCAACCGGGGCGAGTGT |
| 72 | 411C04 - CDRH1 (IMGT) | Amino acid sequence of CDRH1 of 411C04 using IMGT | GFTFSSYW |
| 73 | 411C04 - CDRH2 (IMGT) | Amino acid sequence of CDRH2 of 411C04 using IMGT | IKEDGSEK |
| 74 | 411C04 - CDRH3 (IMGT) | Amino acid sequence of CERH3 of 411C04 usLng IMGT | ARVRLYSDFLDY |
| 75 | 411C04 - CDRH1 (Kabat) | Amino acid sequence of CDRH1 of 411C04 using Kabat | SYWMS |
| 76 | 411C04 - CDRH2 (Kabat) | Amino acid sequence of CDRH2 of 411C04 using Kabat | NIKEDGSEKYYVDSLKG |
| 77 | 411C04 - CDRH3 (Kabat) | Amino acid sequence of CDRH3 of 411C04 using Kabat | VRLYSDFLDY |
| 78 | 411C04 - Heavy chain variable region | Amino acid sequence of $V_H$ of 411C04 | EVQLVDSGGGLVQPGGSLRLSCAASGFTFSSYWMSWVRQAPGKGLE WVANIKEDGSEKYYVDSLKGRFTISRDNAKNSLYLQMNSLRAEDTS VYYCARVRLYSDFLDYWGQGTLVTVSS |
| 79 | 411C04 - Heavy chain variable region | Nucleic acid sequence of $V_H$ of 411C04 | GAGGTGCAGCTGGTGGACTCTGGGGGAGGCTTGGTCCAGCCTGGGG GGTCCCTGAGACTCTCCTGTGCAGCCTCTGGATTCACGTTTAGTAG CTATTGGATGAGTTGGGTCCGCCAGGCTCCAGGAAAGGGGCTGGAG TGGGTGGCCAACATAAAAGAAGATGGAAGTGAGAAATACTATGTAG ACTCTTTGAAGGGCCGATTCACCATCTCCAGAGACAACGCCAAGAA CTCACTGTATCTGCAAATGAACAGCCTGAGAGCCGAGGACACGTCT GTGTATTACTGTGCGAGAGTTCGACTCTACAGTGACTTCCTTGACT ACTGGGGCCAGGGAACCCTGGTCACCGTCTCCTCAG |
| 80 | 411C04 - full heavy chain sequence | Amino acid sequence of 411C04 heavy chain | EVQLVDSGGGLVQPGGSLRLSCAASGFTFSSYWMSWVRQAPGKGLE WVANIKEDGSEKYYVDSLKGRFTISRDNAKNSLYLQMNSLRAEDTS VYYCARVRLYSDFLDYWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPP CPAPELLGGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPAPIEKTISKAKGQPREPQVYTLPPSRDELTKNQVSLT |

TABLE S1-continued

SEQ ID NOS: 1-342

| SEQ ID NO: | Name | Description | Sequence |
|---|---|---|---|
| | | | CLVKGFYPSDIAVEWESNGQPENNYKTTPPVLDSDGSFFLYSKLTV<br>DKSRWQQGNVFSCSVMHEALHNHYTQKSLSLSPGK |
| 81 | 411C04 - full heavy chain sequence | Nucleic acid sequence of 411C04 heavy chain | GAGGTGCAGCTGGTGGACTCTGGGGGAGGCTTGGTCCAGCCTGGGG<br>GGTCCCTGAGACTCTCCTGTGCAGCCTCTGGATTCACGTTTAGTAG<br>CTATTGGATGAGTTGGGTCCGCCAGGCTCCAGGAAAGGGGCTGGAG<br>TGGGTGGCCAACATAAAAGAAGATGGAAGTGAGAAATACTATGTAG<br>ACTCTTTGAAGGGCCGATTCACCATCTCCAGAGACAACGCCAAGAA<br>CTCACTGTATCTGCAAATGAACAGCCTGAGAGCCGAGGACACGTCT<br>GTGTATTACTGTGCGAGAGTTCGACTCTACAGTGACTTCCTTGACT<br>ACTGGGGCCAGGGAACCCTGGTCACCGTCTCCTCAGCCAGCACCAA<br>GGGCCCCTCTGTGTTCCCTCTGGCCCCTTCCAGCAAGTCCACCTCT<br>GGCGGAACAGCCGCTCTGGGCTGCCTCGTGAAGGACTACTTCCCCG<br>AGCCTGTGACCGTGTCCTGGAACTCTGGCGCTCTGACCAGCGGAGT<br>GCACACCTTCCCTGCTGTGCTGCAGTCCTCCGGCCTGTACTCCCTG<br>TCCTCCGTCGTGACCGTGCCTTCCAGCTCTCTGGGCACCCAGACCT<br>ACATCTGCAACGTGAACCACAAGCCCTCCAACACCAAGGTGGACAA<br>GAAGGTGGAACCCAAGTCCTGCGACAAGACCCACACCTGTCCCCCT<br>TGTCCTGCCCCTGAACTGCTGGGCGGACCTTCCGTGTTCCTGTTCC<br>CCCCAAAGCCCAAGGACACCCTGATGATCTCCCGGACCCCCGAAGT<br>GACCTGCGTGGTGGTGGATGTGTCCCACGAGGACCCTGAAGTGAAG<br>TTCAATTGGTACGTGGACGGCGTGGAAGTGCACAACGCCAAGACCA<br>AGCCTAGAGAGGAACAGTACAACTCCACCTACCGGGTGGTGTCCGT<br>GCTGACCGTGCTGCACCAGGATTGGCTGAACGGCAAAGAGTACAAG<br>TGCAAGGTGTCCAACAAGGCCCTGCCTGCCCCCATCGAAAAGACCA<br>TCTCCAAGGCCAAGGGCCAGCCCCGGGAACCCCAGGTGTACACACT<br>GCCCCCTAGCAGGGACGAGCTGACCAAGAACCAGGTGTCCCTGACC<br>TGTCTCGTGAAAGGCTTCTACCCCTCCGATATCGCCGTGGAATGGG<br>AGTCCAACGGCCAGCCTGAGAACAACTACAAGACCACCCCCCCTGT<br>GCTGGACTCCGACGGCTCATTCTTCCTGTACAGCAAGCTGACAGTG<br>GACAAGTCCCGGTGGCAGCAGGGCAACGTGTTCTCCTGCTCCGTGA<br>TGCACGAGGCCCTGCACAACCACTACACCCAGAAGTCCCTGTCCCT<br>GAGCCCCGGCAAG |
| 82 | 411C04 - CDRL1 (IMGT) | Amino acid sequence of CDRL1 of 411C04 using IMGT | QGVSSW |
| 83 | 411C04 - CDRL2 (IMGT) | Amino acid sequence of CDRL2 of 411C04 using IMGT | GAS |
| 84 | 411C04 - CDRL3 (IMGT) | Amino acid sequence of CDRL3 of 411C04 using IMGT | QQANSIPFT |
| 85 | 411C04 - CDRL1 (Kabat) | Amino acid sequence of CDRL1 of 411C04 using Kabat | RASQGVSSWLA |
| 86 | 411C04 - CDRL2 (Kabat) | Amino acid sequence of CDRL2 of 411C04 using Kabat | GASSLQS |
| 87 | 411C04 - CDRL3 (Kabat) | Amino acid sequence of CDRL3 of 411C04 using Kabat | QQANSIPFT |
| 88 | 411C04 - Light chain variable region | Amino acid sequence of $V_L$ of 411C04 | DIQMTQSPSSVSASVGDRVTITCRASQGVSSWLAWYQQKSGKAPKL<br>LIYGASSLQSGVPSRFSGSGSGTEFILSISSLQPEDFATYYCQQAN<br>SIPFTFGPGTKVDIK |

TABLE S1-continued

SEQ ID NOS: 1-342

| SEQ ID NO: | Name | Description | Sequence |
|---|---|---|---|
| 89 | 411C04 - Light chain variable region | Nucleic acid sequence of V<sub>L</sub> of 411C04 | GACATCCAGATGACCCAGTCTCCATCTTCCGTGTCTGCATCTGTCG GAGACAGAGTCACCATCACTTGTCGGGCGAGTCAGGGTGTTAGCAG TTGGTTAGCCTGGTATCAGCAGAAATCAGGGAAAGCCCCTAAGCTC CTGATCTATGGTGCCTCCAGTTTGCAAAGTGGGGTCCCATCAAGAT TCAGCGGCAGTGGATCTGGGACAGAGTTCATTCTCAGCATCAGCAG CCTGCAGCCTGAAGATTTTGCAACTTACTATTGTCAACAGGCTAAC AGTATCCCATTCACTTTCGGCCCTGGGACCAAAGTGGATATCAAAC |
| 90 | 411C04 - full light chain sequence | Amino acid sequence of 411C04 light chain | DIQMTQSPSSVSASVGDRVTITCRASQGVSSWLAWYQQKSGKAPKL LIYGASSLQSGVPSRFSGSGSGTEFILSISSLQPEDFATYYCQQAN SIPFTFGPGTKVDIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 91 | 411C04 - full light chain sequence | Nucleic acid sequence of 411C04 light chain | GACATCCAGATGACCCAGTCTCCATCTTCCGTGTCTGCATCTGTCG GAGACAGAGTCACCATCACTTGTCGGGCGAGTCAGGGTGTTAGCAG TTGGTTAGCCTGGTATCAGCAGAAATCAGGGAAAGCCCCTAAGCTC CTGATCTATGGTGCCTCCAGTTTGCAAAGTGGGGTCCCATCAAGAT TCAGCGGCAGTGGATCTGGGACAGAGTTCATTCTCAGCATCAGCAG CCTGCAGCCTGAAGATTTTGCAACTTACTATTGTCAACAGGCTAAC AGTATCCCATTCACTTTCGGCCCTGGGACCAAAGTGGATATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTCCAAGGCC GACTACGAGAAGCACAAGGTGTACGCCTGCGAAGTGACCCACCAGG GCCTGTCTAGCCCCGTGACCAAGTCTTTCAACCGGGGCGAGTGT |
| 92 | 411D07 - CDRH1 (IMGT) | Amino acid sequence of CDRH1 of 411D07 using IMGT | GGSIISSDW |
| 93 | 411D07 - CDRH2 (IMGT) | Amino acid sequence of CDRH2 of 411D07 using IMGT | IFHSGRT |
| 94 | 411D07 - CDRH3 (IMGT) | Amino acid sequence of CDRH3 of 411D07 using IMGT | ARDGSGSY |
| 95 | 411D07 - CDRH1 (Kabat) | Amino acid sequence of CDRH1 of 411D07 using Kabat | SSDWWN |
| 96 | 411D07 - CDRH2 (Kabat) | Amino acid sequence of CDRH2 of 411D07 using Kabat | EIFHSGRTNYNPSLKS |
| 97 | 411D07 - CDRH3 (Kabat) | Amino acid sequence of CDRH3 of 411D07 using Kabat | DGSGSY |
| 98 | 411D07 - Heavy chain variable region | Amino acid sequence of V<sub>H</sub> of 411D07 | QVQLQESGPGLVKPSGTLSLTCIVSGGSIISSDWWNWVRQPPGKGL EWIGEIFHSGRTNYNPSLKSRVTISIDKSKNQFSLRLSSVTAADTA VYYCARDGSGSYWGQGTLVTVSS |
| 99 | 411D07 - Heavy chain variable region | Nucleic acid sequence of V<sub>H</sub> of 411D07 | CAGGTGCAGCTGCAGGAGTCGGGCCCAGGACTGGTGAAGCCTTCGG GGACCCTGTCCCTCACCTGCATTGTCTCTGGTGGCTCCATCATCAG TAGTGACTGGTGGAATTGGGTCCGCCAGCCCCCAGGGAAGGGGCTG GAGTGGATTGGAGAAATCTTTCATAGTGGGAGGACCAACTACAACC CGTCCCTCAAGAGTCGAGTCACCATATCAATAGACAAGTCCAAGAA TCAGTTCTCCCTGAGGCTGAGCTCTGTGACCGCCGCGGACACGGCC GTGTATTACTGTGCGAGAGATGGTTCGGGGAGTTACTGGGGCCAGG GAACCCTGGTCACCGTCTCCTCAG |

TABLE S1-continued

SEQ ID NOS: 1-342

| SEQ ID NO: | Name | Description | Sequence |
|---|---|---|---|
| 100 | 411D07 - full heavy chain sequence | Amino acid sequence of 411D07 heavy chain | QVQLQESGPGLVKPSGTLSLTCIVSGGSIISSDWWNWVRQPPGKGL EWIGEIFHSGRTNYNPSLKSRVTISIDKSKNQFSLRLSSVTAADTA VYYCARDGSGSYWGQGTLVTVSSASTKGPSVFPLAPSSKSTSGGTA ALGCLVKDYFPEPVTVSWNSGALTSGVHTFPAVLQSSGLYSLSSVV TVPSSSLGTQTYICNVNHKPSNTKVDKKVEPKSCDKTHTCPPCPAP ELLGGPSVFLFPPKPKDTLMISRTPEVTCVVVDVSHEDPEVKFNWY VDGVEVHNAKTKPREEQYNSTYRVVSVLTVLHQDWLNGKEYKCKVS NKALPAPIEKTISKAKGQPREPQVYTLPPSRDELTKNQVSLTCLVK GFYPSDIAVEWESNGQPENNYKTTPPVLDSDGSFFLYSKLTVDKSR WQQGNVFSCSVMHEALHNHYTQKSLSLSPGK |
| 101 | 411D07 - full heavy chain sequence | Nucleic acid sequence of 411D07 heavy chain | CAGGTGCAGCTGCAGGAGTCGGGCCCAGGACTGGTGAAGCCTTCGG GGACCCTGTCCCTCACCTGCATTGTCTCTGGTGGCTCCATCATCAG TAGTGACTGGTGGAATTGGGTCCGCCAGCCCCCAGGGAAGGGGCTG GAGTGGATTGGAGAAATCTTTCATAGTGGGAGGACCAACTACAACC CGTCCCTCAAGAGTCGAGTCACCATATCAATAGACAAGTCCAAGAA TCAGTTCTCCCTGAGGCTGAGCTCTGTGACCGCCGCGGACACGGCC GTGTATTACTGTGCGAGAGATGGTTCGGGGAGTTACTGGGGCCAGG GAACCCTGGTCACCGTCTCCTCAGCCAGCACCAAGGGCCCCTCTGT GTTCCCTCTGGCCCCTTCCAGCAAGTCCACCTCTGGCGGAACAGCC GCTCTGGGCTGCCTCGTCAAGGACTACTTCCCCGAGCCTGTGACCG TGTCCTGGAACTCTGGCGCTCTGACCAGCGGAGTGCACACCTTCCC TGCTGTGCTGCAGTCCTCCGGCCTGTACTCCCTGTCCTCCGTCGTG ACCGTGCCTTCCAGCTCTCTGGGCACCCAGACCTACATCTGCAACG TGAACCACAAGCCCTCCAACACCAAGGTGGACAAGAAGGTGGAACC CAAGTCCTGCGACAAGACCCACACCTGTCCCCCTTGTCCTGCCCCT GAACTGCTGGGCGGACCTTCCGTGTTCCTGTTCCCCCCAAAGCCCA AGGACACCCTGATGATCTCCCGGACCCCCGAAGTGACCTGCGTGGT GGTGGATGTGTCCCACGAGGACCCTGAAGTGAAGTTCAATTGGTAC GTGGACGGCGTGGAAGTGCACAACGCCAAGACCAAGCCTAGAGAGG AACAGTACAACTCCACCTACCGGGTGGTGTCCGTGCTGACCGTGCT GCACCAGGATTGGCTGAACGGCAAAGAGTACAAGTGCAAGGTGTCC AACAAGGCCCTGCCTGCCCCCATCGAAAAGACCATCTCCAAGGCCA AGGGCCAGCCCCGGGAACCCCAGGTGTACACACTGCCCCCTAGCAG GGACGAGCTGACCAAGAACCAGGTGTCCCTGACCTGTCTCGTGAAA GGCTTCTACCCCTCCGATATCGCCGTGGAATGGGAGTCCAACGGCC AGCCTGAGAACAACTACAAGACCACCCCCCCTGTGCTGGACTCCGA CGGCTCATTCTTCCTGTACAGCAAGCTGACAGTGGACAAGTCCCGG TGGCAGCAGGGCAACGTGTTCTCCTGCTCCGTGATGCACGAGGCCC TGCACAACCACTACACCCAGAAGTCCCTGTCCCTGAGCCCCGGCAA G |
| 102 | 411D07 - CDRL1 (IMGT) | Amino acid sequence of CDRL1 of 411D07 using IMGT | QSVLYSSNNKNY |
| 103 | 411D07 - CDRL2 (IMGT) | Amino acid sequence of CDRL2 of 411D07 using IMGT | WAS |
| 104 | 411D07 - CDRL3 (IMGT) | Amino acid sequence of CDRL3 of 411D07 using IMGT | QQYYSNRS |
| 105 | 411D07 - CDRL1 (Kabat) | Amino acid sequence of CDRL1 of 411D07 using Kabat | KSSQSVLYSSNNKNYLA |
| 106 | 411D07 - CDRL2 (Kabat) | Amino acid sequence of CDRL2 of 411D07 using Kabat | WASTRES |
| 107 | 411D07 - CDRL3 (Kabat) | Amino acid sequence of CDRL3 of 411D07 using Kabat | QQYYSNRS |

TABLE S1-continued

SEQ ID NOS: 1-342

| SEQ ID NO:Name | Description | Sequence |
|---|---|---|
| 108 411D07 - Light chain variable region | Amino acid sequence of $V_L$ of 411D07 | DIVMTQSPDSLAVSLGERATINCKSSQSVLYSSNNKNYLAWYQQKS GQPPKLLIYWASTRESGVPDRFSGSGSGTDFTLTISSLQTEDVAVY YCQQYYSNRSFGQGTKLEIK |
| 109 411D07 - Light chain variable region | Nucleic acid sequence of $V_L$ of 411D07 | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAATAAGAATTACTTAGCTTGGTACCAGCAGAAATCA GGACAGCCTCCTAAGTTGCTCATTTACTGGGCATCTACCCGGGAAT CCGGGGTCCCTGACCGATTCAGTGGCAGCGGGTCTGGGACAGATTT CACTCTCACCATCAGCAGCCTGCAGACTGAAGATGTGGCAGTTTAT TACTGTCAGCAATATTATAGTAATCGCAGTTTTGGCCAGGGGACCA AGCTGGAGATCAAAC |
| 110 411D07 - full light chain sequence | Amino acid sequence of 411D07 light chain | DIVMTQSPDSLAVSLGERATINCKSSQSVLYSSNNKNYLAWYQQKS GQPPKLLIYWASTRESGVPDRFSGSGSGTDFTLTISSLQTEDVAVY YCQQYYSNRSFGQGTKLEIKRTVAAPSVFIFPPSDEQLKSGTASVV CLLNNFYPREAKVQWKVDNALQSGNSQESVTEQDSKDSTYSLSSTL TLSKADYEKEKVYACEVTHQGLSSPVTKSENRGEC |
| 111 411D07 - full light chain sequence | Nucleic acid sequence of 411D07 light chain | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAATAAGAATTACTTAGCTTGGTACCAGCAGAAATCA GGACAGCCTCCTAAGTTGCTCATTTACTGGGCATCTACCCGGGAAT CCGGGGTCCCTGACCGATTCAGTGGCAGCGGGTCTGGGACAGATTT CACTCTCACCATCAGCAGCCTGCAGACTGAAGATGTGGCAGTTTAT TACTGTCAGCAATATTATAGTAATCGCAGTTTTGGCCAGGGGACCA AGCTGGAGATCAAACGTACGGTGGCCGCTCCCTCCGTGTTCATCTT CCCACCTTCCGACGAGCAGCTGAAGTCCGGCACCGCTTCTGTCGTG TGCCTGCTGAACAACTTCTACCCCCGCGAGGCCAAGGTGCAGTGGA AGGTGGACAACGCCCTGCAGTCCGGCAACTCCCAGGAATCCGTGAC CGAGCAGGACTCCAAGGACAGCACCTACTCCCTGTCCTCCACCCTG ACCCTGTCCAAGGCCGACTACGAGAAGCACAAGGTGTACGCCTGCG AAGTGACCCACCAGGGCCTGTCTAGCCCCGTGACCAAGTCTTTCAA CCGGGGCGAGTGT |
| 112 385F01 - CDRH1 (IMGT) | Amino acid sequence of CDRH1 of 385F01 using IMGT | GFTFSSYW |
| 113 385F01 - CDRH2 (IMGT) | Amino acid sequence of CDRH2 of 385F01 using IMGT | IKEDGSEK |
| 114 385F01 - CDRH3 (IMGT) | Amino acid sequence of CDRH3 of 385F01 using IMGT | ARNRLYSDFLDN |
| 115 385F01 - CDRH1 (Kabat) | Amino acid sequence of CDRH1 of 385F01 using Kabat | SYWMS |
| 116 385F01 - CDRH2 (Kabat) | Amino acid sequence of CDRH2 of 385F01 using Kabat | NIKEDGSEKYYVDSVKG |
| 117 385F01 - CDRH3 (Kabat) | Amino acid sequence of CDRH3 of 385F01 using Kabat | NRLYSDFLDN |
| 118 385F01 - Heavy chain variable region | Amino acid sequence of $V_H$ of 385F01 | EVQLVESGGGLVQPGGSLRLSCAASGFTFSSYWMSWVRQAPGKGLE WVANIKEDGSEKYYVDSVKGRFTISRDNAKNSLYLQMNSLRAEDTS VYYCARNRLYSDFLDNWGQGTLVTVSS |

TABLE S1-continued

SEQ ID NOS: 1-342

| SEQ ID NO: | Name | Description | Sequence |
|---|---|---|---|
| 119 | 385F01 - Heavy chain variable region | Nucleic acid sequence of V<sub>H</sub> of 385F01 | GAGGTGCAGCTGGTGGAGTCTGGGGGAGGCTTGGTCCAGCCTGGGG GGTCCCTGAGACTCTCCTGTGCAGCCTCTGGATTCACGTTTAGTAG CTATTGGATGAGTTGGGTCCGCCAGGCTCCAGGGAAGGGGCTGGAG TGGGTGGCCAACATCAAAGAAGATGGAAGTGAGAAATACTATGTCG ACTCTGTGAAGGGCCGATTCACCATCTCCAGAGACAACGCCAAGAA CTCACTGTATCTGCAAATGAACAGCCTGAGAGCCGAGGACACGTCT GTGTATTACTGTGCGAGAAATCGACTCTACAGTGACTTCCTTGACA ACTGGGGCCAGGGAACCCTGGTCACCGTCTCCTCAG |
| 120 | 385F01 - full heavy chain sequence | Amino acid sequence of 385E01 heavy chain | EVQLVESGGGLVQPGGSLRLSCAASGFTFSSYWMSWVRQAPGKGLE WVANIKEDGSEKYYVDSVKGRFTISRDNAKNSLYLQMNSLRAEDTS VYYCARNRLYSDFLDNWGQGTLVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPP CPAPELLGGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPAPIEKTISKAKGQPREPQVYTLPPSRDELTKNQVSLT CLVKGFYPSDIAVEWESNGQPENNYKTTPPVLDSDGSFFLYSKLTV DKSRWQQGNVFSCSVMHEALHNHYTQKSLSLSPGK |
| 121 | 385F01 - full heavy chain sequence | Nucleic acid sequence of 385F01 heavy chain | GAGGTGCAGCTGGTGGAGTCTGGGGGAGGCTTGGTCCAGCCTGGGG GGTCCCTGAGACTCTCCTGTGCAGCCTCTGGATTCACGTTTAGTAG CTATTGGATGAGTTGGGTCCGCCAGGCTCCAGGGAAGGGGCTGGAG TGGGTGGCCAACATCAAAGAAGATGGAAGTGAGAAATACTATGTCG ACTCTGTGAAGGGCCGATTCACCATCTCCAGAGACAACGCCAAGAA CTCACTGTATCTGCAAATGAACAGCCTGAGAGCCGAGGACACGTCT GTGTATTACTGTGCGAGAAATCGACTCTACAGTGACTTCCTTGACA ACTGGGGCCAGGGAACCCTGGTCACCGTCTCCTCAGCCAGCACCAA GGGCCCCTCTGTGTTCCCTCTGGCCCCTTCCAGCAAGTCCACCTCT GGCGGAACAGCCGCTCTGGGCTGCCTCGTGAAGGACTACTTCCCCG AGCCTGTGACCGTGTCCTGGAACTCTGGCGCTCTGACCAGCGGAGT GCACACCTTCCCTGCTGTGCTGCAGTCCTCCGGCCTGTACTCCCTG TCCTCCGTCGTGACCGTGCCTTCCAGCTCTCTGGGCACCCAGACCT ACATCTGCAACGTGAACCACAAGCCCTCCAACACCAAGGTGGACAA GAAGGTGGAACCCAAGTCCTGCGACAAGACCCACACCTGTCCCCCT TGTCCTGCCCCTGAACTGCTGGGCGGACCTTCCGTGTTCCTGTTCC CCCCAAAGCCCAAGGACACCCTGATGATCTCCCGGACCCCCGAAGT GACCTGCGTGGTGGTGGATGTGTCCCACGAGGACCCTGAAGTGAAG TTCAATTGGTACGTGGACGGCGTGGAAGTGCACAACGCCAAGACCA AGCCTAGAGAGGAACAGTACAACTCCACCTACCGGGTGGTGTCCGT GCTGACCGTGCTGCACCAGGATTGGCTGAACGGCAAGGAGTACAAG TGCAAGGTGTCCAACAAGGCCCTGCCTGCCCCCATCGAAAAGACCA TCTCCAAGGCCAAGGGCCAGCCCCGGGAACCCCAGGTGTACACACT GCCCCCTAGCAGGGACGAGCTGACCAAGAACCAGGTGTCCCTGACC TGTCTCGTGAAAGGCTTCTACCCCTCCGATATCGCCGTGGAATGGG AGTCCAACGGCCAGCCTGAGAACAACTACAAGACCACCCCCCCTGT GCTGGACTCCGACGGCTCATTCTTCCTGTACAGCAAGCTGACAGTG GACAAGTCCCGGTGGCAGCAGGGCAACGTGTTCTCCTGCTCCGTGA TGCACGAGGCCCTGCACAACCACTACACCCAGAAGTCCCTGTCCCT GAGCCCCGGCAAG |
| 122 | 385F01 - CDRL1 (IMGT) | Amino acid sequence of CDRL1 of 385F01 using IMGT | QGVSSW |
| 123 | 385F01 - CDRL2 (IMGT) | Amino acid sequence of CDRL2 of 385F01 using IMGT | GAS |
| 124 | 385F01 - CDRL3 (IMGT) | Amino acid sequence of CDRL3 of 385F01 using IMGT | QQANSIPFT |
| 125 | 385F01 - CDRL1 (Kabat) | Amino acid sequence of CDRL1 of 385F01 using Kabat | RASQGVSSWLA |

TABLE S1-continued

SEQ ID NOS: 1-342

| SEQ ID NO:Name | Description | Sequence |
|---|---|---|
| 126 385F01 - CDRL2 (Kabat) | Amino acid sequence of CDRL2 of 385F01 using Kabat | GASSLQS |
| 127 385F01 - CDRL3 (Kabat) | Amino acid sequence of CDRL3 of 385F01 using Kabat | QQANSIPFT |
| 128 385F01 - Light chain variable region | Amino acid sequence of V$_L$ of 385F01 | DIQMTQSPSSVSASVGDRVTITCRASQGVSSWLAWYQQKSGKAPKL LIYGASSLQSGVPSRFSGSGSGTEFILTISSLQPEDFATYYCQQAN SIPFTFGPGTKVDIK |
| 129 385F01 - Light chain variable region | Nucleic acid sequence of V$_L$ of 385F01 | GACATCCAGATGACCCAGTCTCCATCTTCCGTGTCTGCATCTGTCG GAGACAGAGTCACCATCACTTGTCGGGCGAGTCAGGGTGTTAGCAG CTGGTTAGCCTGGTATCAGCAGAAATCAGGGAAAGCCCCTAAGCTC CTGATCTATGGTGCATCCAGTTTGCAAAGTGGGGTCCCATCAAGAT TCAGCGGCAGTGGATCTGGGACAGAGTTCATTCTCACCATCAGCAG CCTGCAGCCTGAAGATTTTGCAACTTACTATTGTCAACAGGCTAAC AGTATCCCATTCACTTTCGGCCCTGGGACCAAAGTGGATATCAAAC |
| 130 385F01 - full light chain sequence | Amino acid sequence of 385F01 light chain | DIQMTQSPSSVSASVGDRVTITCRASQGVSSWLAWYQQKSGKAPKL LIYGASSLQSGVPSRFSGSGSGTEFILTISSLQPEDFATYYCQQAN SIPFTFGPGTKVDIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 131 385F01 - full light chain sequence | Nucleic acid sequence of 385F01 light chain | GACATCCAGATGACCCAGTCTCCATCTTCCGTGTCTGCATCTGTCG GAGACAGAGTCACCATCACTTGTCGGGCGAGTCAGGGTGTTAGCAG CTGGTTAGCCTGGTATCAGCAGAAATCAGGGAAAGCCCCTAAGCTC CTGATCTATGGTGCATCCAGTTTGCAAAGTGGGGTCCCATCAAGAT TCAGCGGCAGTGGATCTGGGACAGAGTTCATTCTCACCATCAGCAG CCTGCAGCCTGAAGATTTTGCAACTTACTATTGTCAACAGGCTAAC AGTATCCCATTCACTTTCGGCCCTGGGACCAAAGTGGATATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTC- CAAGGCC. GACTACGAGAAGCACAAGGTGTACGCCTGCGAAGTGACCCACCAGG GCCTGTCTAGCCCCGTGACCAAGTCTTTCAACCGGGGCGAGTGT |
| 132 413D08 - CDRH1 (IMGT) | Amino acid sequence of CDRH1 of 413D08 using IMGT | GFTFRIYG |
| 133 413D08 - CDRH2 (IMGT) | Amino acid sequence of CDRH2 of 413D08 using IMGT | IWYDGSNK |
| 134 413D08 - CDRH3 (IMGT) | Amino acid sequence of CDRH3 of 413D08 using IMGT | ARDMDYFGMDV |
| 135 413D08 - CDRH1 (Kabat) | Amino acid sequence of CDRH1 of 413D08 using Kabat | IYGMH |
| 136 413D08 - CDRH2 (Kabat) | Amino acid sequence of CDRH2 of 413D08 using Kabat | VIWYDGSNKYYADSVKG |

TABLE S1-continued

SEQ ID NOS: 1-342

| SEQ ID NO:Name | Description | Sequence |
|---|---|---|
| 137 413D08 - CDRH3 (Kabat) | Amino acid sequence of CDRH3 of 413D08 using Kabat | DMDYFGMDV |
| 138 413D08 - Heavy chain variable region | Amino acid sequence of $V_H$ of 413D08 | QVQLVESGGGVVQPGRSLRLSCAASGFTFRIYGMHWVRQAPGKGLE WVAVIWYDGSNKYYADSVKGRFTISRDNSDNTLYLQMNSLRAEDTA VYYCARDMDYFGMDVWGQGTTVTVSS |
| 139 413D08 - Heavy chain variable region | Nucleic acid sequence of $V_H$ of 413D08 | CAGGTGCAGCTGGTGGAGTCTGGGGGAGGCGTGGTCCAGCCTGGGA GGTCCCTGAGACTCTCCTGTGCAGCGTCTGGATTCACCTTCCGTAT TTATGGCATGCACTGGGTCCGCCAGGCTCCAGGCAAGGGGCTGGAG TGGGTGGCAGTTATATGGTATGATGGAAGTAATAAATACTATGCTG ACTCCGTAAGGGCCGATTCACCATCTCCAGAGACAATTCCGACAA CACGCTGTATCTGCAAATGAACAGCCTGAGAGCCGAGGACACGGCT GTGTATTACTGTGCGAGAGATATGGACTACTTCGGTATGGACGTCT GGGGCCAAGGGACCACGGTCACCGTCTCCTCAG |
| 140 413D08 - full heavy chain sequence | Amino acid sequence of 413D08 heavy chain | QVQLVESGGGVVQPGRSLRLSCAASGFTFRIYGMHWVRQAPGKGLE WVAVIWYDGSNKYYADSVKGRFTISRDNSDNTLYLQMNSLRAEDTA VYYCARDMDYFGMDVWGQGTTVTVSSASTKGPSVFPLAPSSKSTSG GTAALGCLVKDYFPEPVTVSWNSGALTSGVHTFPAVLQSSGLYSLS SVVTVPSSSLGTQTYICNVNHKPSNTKVDKKVEPKSCDKTHTCPPC PAPELLGGPSVFLFPPKPKDTLMISRTPEVTCVVVDVSHEDPEVKF NWYVDGVEVHNAKTKPREEQYNSTYRVVSVLTVLHQDWLNGKEYKC KVSNKALPAPIEKTISKAKGQPREPQVYTLPPSRDELTKNQVSLTC LVKGFYPSDIAVEWESNGQPENNYKTTPPVLDSDGSFFLYSKLTVD KSRWQQGNVFSCSVMHEALHNHYTQKSLSLSPGK |
| 141 413D08 - full heavy chain sequence | Nucleic acid sequence of 413D08 heavy chain | CAGGTGCAGCTGGTGGAGTCTGGGGGAGGCGTGGTCCAGCCTGGGA GGTCCCTGAGACTCTCCTGTGCAGCGTCTGGATTCACCTTCCGTAT TTATGGCATGCACTGGGTCCGCCAGGCTCCAGGCAAGGGGCTGGAG TGGGTGGCAGTTATATGGTATGATGGAAGTAATAAATACTATGCTG ACTCCGTAAGGGCCGATTCACCATCTCCAGAGACAATTCCGACAA CACGCTGTATCTGCAAATGAACAGCCTGAGAGCCGAGGACACGGCT GTGTATTACTGTGCGAGAGATATGGACTACTTCGGTATGGACGTCT GGGGCCAAGGGACCACGGTCACCGTCTCCTCAGCCAGCACCAAGGG CCCCTCTGTGTTCCCTCTGGCCCCTTCCAGCAAGTCCACCTCTGGC GGAACAGCCGCTCTGGGCTGCCTCGTGAAGGACTACTTCCCCGAGC CTGTGACCGTGTCCTGGAACTCTGGCGCTCTGACCAGCGGAGTGCA CACCTTCCCTGCTGTGCTGCAGTCCTCCGGCCTGTACTCCCTGTCC TCCGTCGTGACCGTGCCTTCCAGCTCTCTGGGCACCCAGACCTACA TCTGCAACGTGAACCACAAGCCCTCCAACACCAAGGTGGACAAGAA GGTGGAACCCAAGTCCTGCGACAAGACCCACACCTGTCCCCCTTGT CCTGCCCCTGAACTGCTGGGCGGACCTTCCGTGTTCCTGTTCCCCC CAAAGCCCAAGGACACCCTGATGATCTCCCGGACCCCCGAAGTGAC CTGCGTGGTGGTGGATGTGTCCCACGAGGACCCTGAAGTGAAGTTC AATTGGTACGTGGACGGCGTGGAAGTGCACAACGCCAAGACCAAGC CTAGAGAGGAACAGTACAACTCCACCTACCGGGTGGTGTCCGTGCT GACCGTGCTGCACCAGGATTGGCTGAACGGCAAAGAGTACAAGTGC AAGGTGTCCAACAAGGCCCTGCCTGCCCCCATCGAAAAGACCATCT CCAAGGCCAAGGGCCAGCCCCGGGAACCCCAGGTGTACACACTGCC CCCTAGCAGGGACGAGCTGACCAAGAACCAGGTGTCCCTGACCTGT CTCGTGAAAGGCTTCTACCCCTCCGATATCGCCGTGGAATGGGAGT CCAACGGCCAGCCTGAGAACAACTACAAGACCACCCCCCCTGTGCT GGACTCCGACGGCTCATTCTTCCTGTACAGCAAGCTGACAGTGGAC AAGTCCCGGTGGCAGCAGGGCAACGTGTTCTCCTGCTCCGTGATGC ACGAGGCCCTGCACAACCACTACACCCAGAAGTCCCTGTCCCTGAG CCCCGGCAAG |
| 142 413D08 - CDRL1 (IMGT) | Amino acid sequence of CDRL1 of 413D08 using IMGT | QGIRND |
| 143 413D08 - CDRL2 (IMGT) | Amino acid sequence of CDRL2 of 413D08 using IMGT | AAS |

TABLE S1-continued

SEQ ID NOS: 1-342

| SEQ ID NO:Name | Description | Sequence |
|---|---|---|
| 144 413D08 - CDRL3 (IMGT) | Amino acid sequence of CDRL3 of 413D08 using IMGT | LQHNSYPRT |
| 145 413D08 - CDRL1 (Kabat) | Amino acid sequence of CDRL1 of 413D08 using Kabat | RASQGIRNDLG |
| 146 413D08 - CDRL2 (Kabat) | Amino acid sequence of CDRL2 of 413D08 using Kabat | AASSLQS |
| 147 413D08 - CDRL3 (Kabat) | Amino acid sequence of CDRL3 of 413D08 using Kabat | LQHNSYPRT |
| 148 413D08 - Light chain variable region | Amino acid sequence of $V_L$ of 413D08 | DLQMTQSPSSLSASVGDRVTITCRASQGIRNDLGWYQQKPGKAPKR LIYAASSLQSGVPSRFSGSGSGTEFTLTISSLQPEDFATYYCLQHN SYPRTFGQGTKVEIK |
| 149 413D08 - Light chain variable region | Nucleic acid sequence of $V_L$ of 413D08 | GACCTCCAGATGACCCAGTCTCCATCCTCCCTGTCTGCATCTGTAG GAGACAGAGTCACCATCACTTGCCGGGCAAGTCAGGGCATTAGAAA TGATTTAGGCTGGTATCAGCAGAAACCAGGGAAAGCCCCTAAGCGC CTGATCTATGCTGCATCCAGTTTGCAAAGTGGGGTCCCATCAAGGT TCAGCGGCAGTGGATCTGGGACAGAATTCACTCTCACAATCAGCAG CCTGCAGCCTGAAGATTTTGCAACTTATTACTGTCTACAGCATAAT AGTTACCCTCGGACGTTCGGCCAAGGGACCAAGGTGGAAATCAAAC |
| 150 413D08 - full light chain sequence | Amino acid sequence of 413D08 light chain | DLQMTQSPSSLSASVGDRVTITCRASQGIRNDLGWYQQKPGKAPKR LIYAASSLQSGVPSRFSGSGSGTEFTLTISSLQPEDFATYYCLQHN SYPRTFGQGTKVEIKRTVAAPSVFIFPPSDEQLKSGTASVVCLLNN FYPREAKVQWKVDNALQSGNSQESVTEQDSKDSTYSLSSTLTLSKA DYEKHKVYACEVTHQGLSSPVTKSFNRGEC |
| 151 413D08 - full light chain sequence | Nucleic acid sequence of 413D08 light chain | GACCTCCAGATGACCCAGTCTCCATCCTCCCTGTCTGCATCTGTAG GAGACAGAGTCACCATCACTTGCCGGGCAAGTCAGGGCATTAGAAA TGATTTAGGCTGGTATCAGCAGAAACCAGGGAAAGCCCCTAAGCGC CTGATCTATGCTGCATCCAGTTTGCAAAGTGGGGTCCCATCAAGGT TCAGCGGCAGTGGATCTGGGACAGAATTCACTCTCACAATCAGCAG CCTGCAGCCTGAAGATTTTGCAACTTATTACTGTCTACAGCATAAT AGTTACCCTCGGACGTTCGGCCAAGGGACCAAGGTGGAAATCAAAC GTACGGTGGCCGCTCCCTCCGTGTTCATCTTCCCACCTTCCGACGA GCAGCTGAAGTCCGGCACCGCTTCTGTCGTGTGCCTGCTGAACAAC TTCTACCCCCGCGAGGCCAAGGTGCAGTGGAAGGTGGACAACGCCC TGCAGTCCGGCAACTCCCAGGAATCCGTGACCGAGCAGGACTCCAA GGACAGCACCTACTCCCTGTCCTCCACCCTGACCCTGTCCAAGGCC GACTACGAGAAGCACAAGGTGTACGCCTGCGAAGTGACCCACCAGG GCCTGTCTAGCCCCGTGACCAAGTCTTTCAACCGGGGCGAGTGT |
| 152 386H03 - CDRH1 (IMGT) | Amino acid sequence of CDRH1 of 386H03 using IMGT | GGSISSSDW |
| 153 386H03 - CDRH2 (IMGT) | Amino acid sequence of CDRH2 of 386H03 using IMGT | IFHSGNT |
| 154 386H03 - CDRH3 (IMGT) | Amino acid sequence of CDRH3 of 386H03 using IMGT | VRDGSGSY |

TABLE S1-continued

SEQ ID NOS: 1-342

| SEQ ID NO: | Name | Description | Sequence |
|---|---|---|---|
| 155 | 386H03 - CDRH1 (Kabat) | Amino acid sequence of CDRH1 of 386H03 using Kabat | SSDWWS |
| 156 | 386H03 - CDRH2 (Kabat) | Amino acid sequence of CDRH2 of 386H03 using Kabat | EIFHSGNTNYNPSLKS |
| 157 | 386H03 - CDRH3 (Kabat) | Amino acid sequence of CDRH3 of 386H03 using Kabat | DGSGSY |
| 158 | 386H03 - Heavy chain variable region | Amino acid sequence of V$_H$ of 386H03 | QVQLQESGPGLVKPSGTLSLTCAVSGGSISSSDWWSWVRQPPGKGL EWIGEIFHSGNTNYNPSLKSRVTISVDKSKNQISLRLNSVTAADTA VYYCVRDGSGSYWGQGTLVTVSS |
| 159 | 386H03 - Heavy chain variable region | Nucleic acid sequence of V$_H$ of 386H03 | CAGGTGCAGCTGCAGGAGTCGGGCCCAGGACTGGTGAAGCCTTCGG GGACCCTGTCCCTCACCTGCGCTGTCTCTGGTGGCTCCATCAGCAG TAGTGACTGGTGGAGTTGGGTCCGCCAGCCCCCAGGGAAGGGGCTG GAGTGGATTGGGGAAATCTTTCATAGTGGGAACACCAACTACAACC CGTCCCTCAAGAGTCGAGTCACCATATCAGTAGACAAGTCCAAGAA CCAGATCTCCCTGAGGCTGAACTCTGTGACCGCCGCGGACACGGCC GTGTATTACTGTGTGAGAGATGGTTCGGGGAGTTACTGGGGCCAGG GAACCCTGGTCACCGTCTCCTCAG |
| 160 | 386H03 - full heavy chain sequence | Amino acid sequence of 386H03 heavy chain | QVQLQESGPGLVKPSGTLSLTCAVSGGSISSSDWWSWVRQPPGKGL EWIGEIFHSGNTNYNPSLKSRVTISVDKSKNQISLRLNSVTAADTA VYYCVRDGSGSYWGQGTLVTVSSASTKGPSVFPLAPSSKSTSGGTA ALGCLVKDYFPEPVTVSWNSGALTSGVHTFPAVLQSSGLYSLSSVV TVPSSSLGTQTYICNVNHKPSNTKVDKKVEPKSCDKTHTCPPCPAP ELLGGPSVFLFPPKPKDTLMISRTPEVTCVVVDVSHEDPEVKFNWY VDGVEVHNAKTKPREEQYNSTYRVVSVLTVLHQDWLNGKEYKCKVS NKALPAPIEKTISKAKGQPREPQVYTLPPSRDELTKNQVSLTCLVK GFYPSDIAVEWESNGQPENNYKTTPPVLDSDGSFFLYSKLTVDKSR WQQGNVFSCSVMHEALHNHYTQKSLSLSPGK |
| 161 | 386H03 - full heavy chain sequence | Nucleic acid sequence of 386H03 heavy chain | CAGGTGCAGCTGCAGGAGTCGGGCCCAGGACTGGTGAAGCCTTCGG GGACCCTGTCCCTCACCTGCGCTGTCTCTGGTGGCTCCATCAGCAG TAGTGACTGGTGGAGTTGGGTCCGCCAGCCCCCAGGGAAGGGGCTG GAGTGGATTGGGGAAATCTTTCATAGTGGGAACACCAACTACAACC CGTCCCTCAAGAGTCGAGTCACCATATCAGTAGACAAGTCCAAGAA CCAGATCTCCCTGAGGCTGAACTCTGTGACCGCCGCGGACACGGCC GTGTATTACTGTGTGAGAGATGGTTCGGGGAGTTACTGGGGCCAGG GAACCCTGGTCACCGTCTCCTCAGCCAGCACCAAGGGCCCCTCTGT GTTCCCTCTGGCCCCTTCCAGCAAGTCCACCTCTGGCGGAACAGCC GCTCTGGGCTGCCTCGTGAAGGACTACTTCCCCGAGCCTGTGACCG TGTCCTGGAACTCTGGCGCTCTGACCAGCGGAGTGCACACCTTCCC TGCTGTGCTGCAGTCCTCCGGCCTGTACTCCCTGTCCTCCGTCGTG ACCGTGCCTTCCAGCTCTCTGGGCACCCAGACCTACATCTGCAACG TGAACCACAAGCCCTCCAACACCAAGGTGGACAAGAAGGTGGAACC CAAGTCCTGCGACAAGACCCACACCTGTCCCCCTTGTCCTGCCCCT GAACTGCTGGGCGGACCTTCCGTGTTCCTGTTCCCCCCAAAGCCCA AGGACACCCTGATGATCTCCCGGACCCCCGAAGTGACCTGCGTGGT GGTGGATGTGTCCCACGAGGACCCTGAAGTGAAGTTCAATTGGTAC GTGGACGGCGTGGAAGTGCACAACGCCAAGACCAAGCCTAGAGAGG AACAGTACAACTCCACCTACCGGGTGGTGTCCGTGCTGACCGTGCT GCACCAGGATTGGCTGAACGGCAAAGAGTACAAGTGCAAGGTGTCC AACAAGGCCCTGCCTGCCCCCATCGAAAAGACCATCTCCAAGGCCA AGGGCCAGCCCCGGGAACCCCAGGTGTACACACTGCCCCCTAGCAG GGACGAGCTGACCAAGAACCAGGTGTCCCTGACCTGTCTCGTGAAA GGCTTCTACCCCTCCGATATCGCCGTGGAATGGGAGTCCAACGGCC AGCCTGAGAACAACTACAAGACCACCCCCCCTGTGCTGGACTCCGA CGGCTCATTCTTCCTGTACAGCAAGCTGACAGTGGACAAGTCCCGG TGGCAGCAGGGCAACGTGTTCTCCTGCTCCGTGATGCACGAGGCCC TGCACAACCACTACACCCAGAAGTCCCTGTCCCTGAGCCCCGGCAA G |

TABLE S1-continued

SEQ ID NOS: 1-342

| SEQ ID NO:Name | Description | Sequence |
|---|---|---|
| 162 386H03 - CDRL1 (IMGT) | Amino acid sequence of CDRL1 of 386H03 using IMGT | QSVLYSSNNKNY |
| 163 386H03 - CDRL2 (IMGT) | Amino acid sequence of CDRL2 of 386H03 using IMGT | WAS |
| 164 386H03 - CDRL3 (IMGT) | Amino acid sequence of CDRL3 of 386H03 using IMGT | QQYYSTRS |
| 165 386H03 - CDRL1 (Kabat) | Amino acid sequence of CDRL1 of 386H03 using Kabat | KSSQSVLYSSNNKNYLA |
| 166 386H03 - CDRL2 (Kabat) | Amino acid sequence of CDRL2 of 386H03 using Kabat | WASTRES |
| 167 386H03 - CDRL3 (Kabat) | Amino acid sequence of CDRL3 of 386H03 using Kabat | QQYYSTRS |
| 168 386H03 - Light chain variable region | Amino acid sequence of $V_L$ of 386H03 | DIVMTQSPDSLAVSLGERATINCKSSQSVLYSSNNKNYLAWYQQKP GQPPKLLIYWASTRESGVPDRFSGSGSGTDFTLTISSLQAEDVAVY YCQQYYSTRSFGQGTKLEIK |
| 169 386H03 - Light chain variable region | Nucleic acid sequence of $V_L$ of 386H03 | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAATAAGAACTACTTAGCTTGGTACCAGCAGAAACCA GGACAGCCTCCTAAACTGCTCATTTACTGGGCATCTACCCGGGAAT CCGGGGTCCCTGACCGATTCAGTGGCAGCGGGTCTGGGACAGATTT CACTCTCACCATCAGCAGCCTGCAGGCTGAAGATGTGGCAGTTTAT TACTGTCAGCAATATTATAGTACTCGCAGTTTTGGCCAGGGGACCA AGCTGGAGATCAAAC |
| 170 386H03 - full light chain sequence | Amino acid sequence of 386H03 light chain | DIVMTQSPDSLAVSLGERATINCKSSQSVLYSSNNKNYLAWYQQKP GQPPKLLIYWASTRESGVPDRFSGSGSGTDFTLTISSLQAEDVAVY YCQQYYSTRSFGQGTKLEIKRTVAAPSVFIFPPSDEQLKSGTASVV CLLNNFYPREAKVQWKVDNALQSGNSQESVTEQDSKDSTYSLSSTL TLSKADYEKHKVYACEVTHQGLSSPVTKSFNRGEC |
| 171 386H03 - full light chain sequence | Nucleic acid of 386H03 sequence light chain | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAATAAGAACTACTTAGCTTGGTACCAGCAGAAACCA GGACAGCCTCCTAAACTGCTCATTTACTGGGCATCTACCCGGGAAT CCGGGGTCCCTGACCGATTCAGTGGCAGCGGGTCTGGGACAGATTT CACTCTCACCATCAGCAGCCTGCAGGCTGAAGATGTGGCAGTTTAT TACTGTCAGCAATATTATAGTACTCGCAGTTTTGGCCAGGGGACCA AGCTGGAGATCAAACGTACGGTGGCCGCTCCCTCCGTGTTCATCTT CCCACCTTCCGACGAGCAGCTGAAGTCCGGCACCGCTTCTGTCGTG TGCCTGCTGAACAACTTCTACCCCCGCGAGGCCAAGGTGCAGTGGA AGGTGGACAACGCCCTGCAGTCCGGCAACTCCCAGGAATCCGTGAC CGAGCAGGACTCCAAGGACAGCACCTACTCCCTGTCCTCCACCCTG ACCCTGTCCAAGGCCGACTACGAGAAGCACAAGGTGTACGCCTGCG AAGTGACCCACCAGGGCCTGTCTAGCCCCGTGACCAAGTCTTTCAA CCGGGGCGAGTGT |
| 172 389A03 - CDRH1 (IMGT) | Amino acid sequence of CDRH1 of 389A03 using IMGT | GGSISSSSYY |

TABLE S1-continued

SEQ ID NOS: 1-342

| SEQ ID NO:Name | Description | Sequence |
|---|---|---|
| 173 389A03 - CDRH2 (IMGT) | Amino acid sequence of CDRH2 of 389A03 using IMGT | IYSTGYT |
| 174 389A03 - CDRH3 (IMGT) | Amino acid sequence of CDRH3 of 389A03 using IMGT | AISTAAGPEYFHR |
| 175 389A03 - CDRH1 (Kabat) | Amino acid sequence of CDRH1 of 389A03 using Kabat | SSSYYCG |
| 176 389A03 - CDRH2 (Kabat) | Amino acid sequence of CDRH2 of 389A03 using Kabat | SIYSTGYTYYNPSLKS |
| 177 389A03 - CDRH3 (Kabat) | Amino acid sequence of CDRH3 of 389A03 using Kabat | STAAGPEYFHR |
| 178 389A03 - Heavy chain variable region | Amino acid sequence of $V_H$ of 389A03 | QLQESGPGLVKPSETLSLTCTVSGGSISSSSYYCGWIRQPPGKGLD WIGSIYSTGYTYYNPSLKSRVTISIDTSKNQFSCLILTSVTAADTA VYYCAISTAAGPEYFHRWGQGTLVTVSS |
| 179 389A03 - Heavy chain variable region | Nucleic acid sequence of $V_H$ of 389A03 | CAGCTGCAGGAGTCGGGCCCAGGCCTGGTGAAGCCTTCGGAGACCC TGTCCCTCACCTGCACTGTCTCTGGTGGCTCCATCAGCAGTAGTAG TTATTACTGCGGCTGGATCCGCCAGCCCCCTGGGAAGGGGCTGGAC TGGATTGGGAGTATCTATTCTACTGGGTACACCTACTACAACCCGT CCCTCAAGAGTCGAGTCACCATTTCCATAGACACGTCCAAGAACCA GTTCTCATGCCTGATACTGACCTCTGTGACCGCCGCAGACACGGCT GTGTATTACTGTGCGATAAGTACAGCAGCTGGCCCTGAATACTTCC ATCGCTGGGGCCAGGGCACCCTGGTCACCGTCTCCTCAG |
| 180 389A03 - full heavy chain sequence | Amino acid sequence of 389A03 heavy chain | QLQESGPGLVKPSETLSLTCTVSGGSISSSSYYCGWIRQPPGKGLD WIGSIYSTGYTYYNPSLKSRVTISIDTSKNQFSCLILTSVTAADTA VYYCAISTAAGPEYFHRWGQGTLVTVSSASTKGPSVFPLAPSSKST SGGTAALGCLVKDYFPEPVTVSWNSGALTSGVHTFPAVLQSSGLYS LSSVVTVPSSSLGTQTYICNVNHKPSNTKVDKKVEPKSCDKTHTCP PCPAPELLGGPSVFLFPPKPKDTLMISRTPEVTCVVVDVSHEDPEV KFNWYVDGVEVHNAKTKPREEQYNSTYRVVSVLTVLHQDWLNGKEY KCKVSNKALPAPIEKTISKAKGQPREPQVYTLPPSRDELTKNQVSL TCLVKGFYPSDIAVEWESNGQPENNYKTTPPVLDSDGSFFLYSKLT VDKSRWQQGNVFSCSVMHEALHNHYTQKSLSLSPGK |
| 181 389A03 - full heavy chain sequence | Nucleic acid sequence of 389A03 heavy chain | CAGCTGCAGGAGTCGGGCCCAGGCCTGGTGAAGCCTTCGGAGACCC TGTCCCTCACCTGCACTGTCTCTGGTGGCTCCATCAGCAGTAGTAG TTATTACTGCGGCTGGATCCGCCAGCCCCCTGGGAAGGGGCTGGAC TGGATTGGGAGTATCTATTCTACTGGGTACACCTACTACAACCCGT CCCTCAAGAGTCGAGTCACCATTTCCATAGACACGTCCAAGAACCA GTTCTCATGCCTGATACTGACCTCTGTGACCGCCGCAGACACGGCT GTGTATTACTGTGCGATAAGTACAGCAGCTGGCCCTGAATACTTCC ATCGCTGGGGCCAGGGCACCCTGGTCACCGTCTCCTCAGCCAGCAC CAAGGGCCCCTCTGTGTTCCCTCTGGCCCCTTCCAGCAAGTCCACC TCTGGCGGAACAGCCGCTCTGGGCTGCCTCGTGAAGGACTACTTCC CCGAGCCTGTGACCGTGTCCTGGAACTCTGGCGCTCTGACCAGCGG AGTGCACACCTTCCCTGCTGTGCTGCAGTCCTCCGGCCTGTACTCC CTGTCCTCCGTCGTGACCGTGCCTTCCAGCTCTCTGGGCACCCAGA CCTACATCTGCAACGTGAACCACAAGCCCTCCAACACCAAGGTGGA CAAGAAGGTGGAACCCAAGTCCTGCGACAAGACCCACACCTGTCCC CCTTGTCCTGCCCCTGAACTGCTGGGCGGACCTTCCGTGTTCCTGT TCCCCCCAAAGCCCAAGGACACCCTGATGATCTCCAGACCCCCCGA AGTGACCTGCGTGGTGGTGGATGTGTCCCACGAGGACCCTGAAGTG AAGTTCAATTGGTACGTGGACGGCGTGGAAGTGCACAACGCCAAGA CCAAGCCTAGAGAGGAACAGTACAACTCCACCTACCGGGTGGTGTC CGTGCTGACCGTGCTGCACCAGGATTGGCTGAACGGCAAAGAGTAC AAGTGCAAGGTGTCCAACAAGGCCCTGCCTGCCCCCATCGAAAAGA |

TABLE S1-continued

SEQ ID NOS: 1-342

| SEQ ID NO:Name | Description | Sequence |
|---|---|---|
| | | CCATCTCCAAGGCCAAGGGCCAGCCCCGGGAACCCCAGGTGTACAC ACTGCCCCCTAGCAGGGACGAGCTGACCAAGAACCAGGTGTCCCTG ACCTGTCTCGTGAAAGGCTTCTACCCCTCCGATATCGCCGTGGAAT GGGAGTCCAACGGCCAGCCTGAGAACAACTACAAGACCACCCCCCC TGTGCTGGACTCCGACGGCTCATTCTTCCTGTACAGCAAGCTGACA GTGGACAAGTCCCGGTGGCAGCAGGGCAACGTGTTCTCCTGCTCCG TGATGCACGAGGCCCTGCACAACCACTACACCCAGAAGTCCCTGTC CCTGAGCCCCGGCAAG |
| 182 389A03 - CDRL1 (IMGT) | Amino acid sequence of CDRL1 of 389A03 using IMGT | QSVLYSSNSKNF |
| 183 389A03 - CDRL2 (IMGT) | Amino acid sequence of CDRL2 of 389A03 using IMGT | WAS |
| 184 389A03 - CDRL3 (IMGT) | Amino acid sequence of CDRL3 of 389A03 using IMGT | QQYYSTPRT |
| 185 389A03 - CDRL1 (Kabat) | Amino acid sequence of CDRL1 of 389A03 using Kabat | KSSQSVLYSSNSKNFLA |
| 186 389A03 - CDRL2 (Kabat) | Amino acid sequence of CDRL2 of 389A03 using Kabat | WASTRGS |
| 187 389A03 - CDRL3 (Kabat) | Amino acid sequence of CDRL3 of 389A03 using Kabat | QQYYSTPRT |
| 188 389A03 - Light chain variable region | Amino acid sequence of $V_L$ of 389A03 | DIVMTQSPDSLAVSLGERATINCKSSQSVLYSSNSKNFLAWYQQKP GQPPKLFIYWASTRGSGVPDRISGSGSGTDFNLTISSLQAEDVAVY YCQQYYSTPRTFGQGTKVEIK |
| 189 389A03 - Light chain variable region | Nucleic acid sequence of $V_L$ of 389A03 | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAGTAAGAACTTCTTAGCTTGGTACCAGCAGAAACCG GGACAGCCTCCTAAGCTGTTCATTTACTGGGCATCTACCCGGGGAT CCGGGGTCCCTGACCGAATCAGTGGCAGCGGGTCTGGGACAGATTT CAATCTCACCATCAGCAGCCTGCAGGCTGAAGATGTGGCAGTTTAT TACTGTCAACAATATTATAGTACTCCTCGGACGTTCGGCCAAGGGA CCAAGGTGGAGATCAAAC |
| 190 389A03 - full light chain sequence | Amino acid sequence of 389A03 light chain | DIVMTQSPDSLAVSLGERATINCKSSQSVLYSSNSKNFLAWYQQKP GQPPKLFIYWASTRGSGVPDRISGSGSGTDFNLTISSLQAEDVAVY YCQQYYSTPRTFGQGTKVEIKRTVAAPSVFIFPPSDEQLKSGTASV VCLLNNFYPREAKVQWKVDNALQSGNSQESVTEQDSKDSTYSLSST LTLSKADYEKHKVYACEVTHQGLSSPVTKSFNRGEC |
| 191 389A03 - full light chain sequence | Nucleic acid sequence of 389A03 light chain | GACATCGTGATGACCCAGTCTCCAGACTCCCTGGCTGTGTCTCTGG GCGAGAGGGCCACCATCAACTGCAAGTCCAGCCAGAGTGTTTTATA CAGCTCCAACAGTAAGAACTTCTTAGCTTGGTACCAGCAGAAACCG GGACAGCCTCCTAAGCTGTTCATTTACTGGGCATCTACCCGGGGAT CCGGGGTCCCTGACCGAATCAGTGGCAGCGGGTCTGGGACAGATTT CAATCTCACCATCAGCAGCCTGCAGGCTGAAGATGTGGCAGTTTAT TACTGTCAACAATATTATAGTACTCCTCGGACGTTCGGCCAAGGGA CCAAGGTGGAGATCAAACGTACGGTGGCCGCTCCCTCCGTGTTCAT CTTCCCACCTTCCGACGAGCAGCTGAAGTCCGGCACCGCTTCTGTC GTGTGCCTGCTGAACAACTTCTACCCCCGCGAGGCCAAGGTGCAGT GGAAGGTGGACAACGCCCTGCAGTCCGGCAACTCCCAGGAATCCGT GACCGAGCAGGACTCCAAGGACAGCACCTACTCCCTGTCCTCCACC |

TABLE S1-continued

SEQ ID NOS: 1-342

| SEQ ID NO: | Name | Description | | Sequence |
|---|---|---|---|---|
| | | | | CTGACCCTGTCCAAGGCCGACTACGAGAAGCACAAGGTGTACGCCT GCGAAGTGACCCACCAGGGCCTGTCTAGCCCCGTGACCAAGTCTTT CAACCGGGGCGAGTGT |
| 192 | Human IgG4 heavy chain constant region #1 | IGHG*01 & IGHG4*04 | Heavy Chain Constant Region Nucleotide Sequence | gcttccaccaagggcccatccgtcttccccctggcgccctgctcca ggagcacctccgagagcacagccgccctgggctgcctggtcaagga ctacttccccgaaccggtgacggtgtcgtggaactcaggcgccctg accagcggcgtgcacaccttcccggctgtcctacagtcctcaggac tctactccctcagcagcgtggtgaccgtgccctccagcagcttggg cacgaagacctacacctgcaacgtagatcacaagcccagcaacacc aaggtggacaagagagttgagtccaaatatggtcccccatgcccat catgcccagcacctgagttcctggggggaccatcagtcttcctgtt ccccccaaaacccaaggacactctcatgatctcccggacccctgag gtcacgtgcgtggtggtggacgtgagccaggaagaccccgaggtcc agttcaactggtacgtggatggcgtggaggtgcataatgccaagac aaagccgcgggaggagcagttcaacagcacgtaccgtgtggtcagc gtcctcaccgtcctgcaccaggactggctgaacggcaaggagtaca agtgcaaggtctccaacaaaggcctcccgtcctccatcgagaaaac catctccaaagccaaagggcagccccgagagccacaggtgtacacc ctgcccccatcccaggaggagatgaccaagaaccaggtcagcctga cctgcctggtcaaaggcttctaccccagcgacatcgccgtggagtg ggagagcaatgggcagccggagaacaactacaagaccacgcctccc gtgctggactccgacggctccttcttcctctacagcaggctaaccg tggacaagagcaggtggcaggaggggaatgtcttctcatgctccgt gatgcatgaggctctgcacaaccactacacacagaagagcctctcc ctgtctctgggtaaa |
| 193 | | | Heavy Chain Constant Region Amino Acid Sequence | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPSCPAPEFLGGPSVFLFPPKPKDTLMISRTPE VTCVVVDVSQEDPEVQFNWYVDGVEVHNAKTKPREEQFNSTYRVVS VLTVLHQDWLNGKEYKCKVSNKGLPSSIEKTISKAKGQPREPQVYT LPPSQEEMTKNQVSLTCLVKGFYPSDIAVEWESNGQPENNYKTTPP VLDSDGSFFLYSRLTVDKSRWQEGNVFSCSVMHEALHNHYTQKSLS LSLGK |
| 194 | Human IgG4 heavy chain constant region #2 | IGHG*02 | Heavy Chain Constant Region Nucleotide Sequence | gcttccaccaagggcccatccgtcttccccctggcgccctgctcca ggagcacctccgagagcacagccgccctgggctgcctggtcaagga ctacttccccgaaccggtgacggtgtcgtggaactcaggcgccctg accagcggcgtgcacaccttcccggctgtcctacagtcctcaggac tctactccctcagcagcgtggtgaccgtgccctccagcagcttggg cacgaagacctacacctgcaacgtagatcacaagcccagcaacacc aaggtggacaagagagttgagtccaaatatggtcccccgtgcccat catgcccagcacctgagttcctggggggaccatcagtcttcctgtt ccccccaaaacccaaggacactctcatgatctcccggacccctgag gtcacgtgcgtggtggtggacgtgagccaggaagaccccgaggtcc agttcaactggtacgtggatggcgtggaggtgcataatgccaagac aaagccgcgggaggagcagttcaacagcacgtaccgtgtggtcagc gtcctcaccgtcgtgcaccaggactggctgaacggcaaggagtaca agtgcaaggtctccaacaaaggcctcccgtcctccatcgagaaaac catctccaaagccaaagggcagccccgagagccacaggtgtacacc ctgcccccatcccaggaggagatgaccaagaaccaggtcagcctga cctgcctggtcaaaggcttctaccccagcgacatcgccgtggagtg ggagagcaatgggcagccggagaacaactacaagaccacgcctccc gtgctggactccgacggctccttcttcctctacagcaggctaaccg tggacaagagcaggtggcaggaggggaatgtcttctcatgctccgt gatgcatgaggctctgcacaaccactacacgcagaagagcctctcc ctgtctctgggtaaa |
| 195 | | | Heavy Chain Constant Region Amino Acid Sequence | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPSCPAPEFLGGPSVFLFPPKPKDTLMISRTPE VTCVVVDVSQEDPEVQFNWYVDGVEVHNAKTKPREEQFNSTYRVVS VLTVVHQDWLNGKEYKCKVSNKGLPSSIEKTISKAKGQPREPQVYT LPPSQEEMTKNQVSLTCLVKGFYPSDIAVEWESNGQPENNYKTTPP VLDSDGSFFLYSRLTVDKSRWQEGNVFSCSVMHEALHNHYTQKSLS LSLGK |
| 196 | Human IgG4 heavy chain constant | IGHG*03 | Heavy Chain Constant Region Nucleotide | gcttccaccaagggcccatccgtcttccccctggcgccctgctcca ggagcacctccgagagcacagccgccctgggctgcctggtcaagga ctacttccccgaaccggtgacggtgtcgtggaactcaggcgccctg accagcggcgtgcacaccttcccggctgtcctacagtcctcaggac tctactccctcagcagcgtggtgaccgtgccctccagcagcttggg |

TABLE S1-continued

SEQ ID NOS: 1-342

| SEQ ID NO: | Name | Description | Sequence |
|---|---|---|---|
| | region #3 | Sequence | cacgaagacctacacctgcaacgtagatcacaagcccagcaacacc aaggtggacaagagagttgagtccaaatatggtcccccatgccat catgcccagcacctgagttcctgggggggaccatcagtcttcctgtt cccccaaaacccaaggacactctcatgatctcccggacccctgag gtcacgtgcgtggtggtggacgtgagccaggaagaccccgaggtcc agttcaactggtacgtggatggcgtggaggtgcataatgccaagac aaagccgcgggaggagcagttcaacagcacgtaccgtgtggtcagc gtcctcaccgtcctgcaccaggactggctgaacggcaaggagtaca agtgcaaggtctccaacaaaggcctcccgtcctccatcgagaaaac catctccaaagccaaagggcagccccgagagccacaggtgtacacc ctgcccccatcccaggaggagatgaccaagaaccaggtcagcctga cctgcctggtcaaaggcttctaccccagcgacatcgccgtggagtg ggagagcaatgggcagccggagaacaactacaagaccacgcctccc gtgctggactccgacggctccttcttcctctacagcaagctcaccg tggacaagagcaggtggcaggaggggaacgtcttctcatgctccgt gatgcatgaggctctgcacaaccactacacgcagaagagcctctcc ctgtctctgggtaaa |
| 197 | | Heavy Chain Constant Region Amino Acid Sequence | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPSCPAPEFLGGPSVFLFPPKPKDTLMISRTPE VTCVVVDVSQEDPEVQFNWYVDGVEVHNAKTKPREEQFNSTYRVVS VLTVLHQDWLNGKEYKCKVSNKGLPSSIEKTISKAKGQPREPQVYT LPPSQEEMTKNQVSLTCLVKGFYPSDIAVEWESNGQPENNYKTTPP VLDSDGSFFLYSKLTVDKSRWQEGNVFSCSVMHEALHNHYTQKSLS LSLGK |
| 198 | IgG4 heavy chain constant region - IgG4-PE | -IgG4-PE Heavy Chain Constant Region Nucleotide Sequence - Synthetic Version A | gcctccaccaagggcccatccgtcttccccctggcgccctgctcca ggagcacctccgagagcacggccgccctgggctgcctggtcaagga ctacttccccgaaccagtgacggtgtcgtggaactcaggcgccctg accagcggcgtgcacaccttcccggctgtcctacagtcctcaggac tctactccctcagcagcgtggtgaccgtgccctccagcagcttggg cacgaagacctacacctgcaacgtagatcacaagcccagcaacacc aaggtggacaagagagttgagtccaaatatggtcccccatgccac catgcccagcgcctgaatttgagggggaccatcagtcttcctgtt cccccaaaacccaaggacactctcatgatctcccggacccctgag gtcacgtgcgtggtggtggacgtgagccaggaagaccccgaggtcc agttcaactggtacgtggatggcgtggaggtgcataatgccaagac aaagccgcgggaggagcagttcaacagcacgtaccgtgtggtcagc gtcctcaccgtcctgcaccaggactggctgaacggcaaggagtaca agtgcaaggtctccaacaaaggcctcccgtcatcgatcgagaaaac catctccaaagccaaagggcagccccgagagccacaggtgtacacc ctgcccccatcccaggaggagatgaccaagaaccaggtcagcctga cctgcctggtcaaaggcttctaccccagcgacatcgccgtggagtg ggagagcaatgggcagccggagaacaactacaagaccacgcctccc gtgctggactccgacggatccttcttcctctacagcaggctaaccg tggacaagagcaggtggcaggaggggaatgtcttctcatgctccgt gatgcatgaggctctgcacaaccactacacacagaagagcctctcc ctgtctctgggtaaa |
| 199 | IgG4 heavy chain constant region - IgG4-PE | Heavy Chain Constant Region Amino Acid Sequence Encoded by Synthetic Version A, B & C (Two residues that differ from the wild-type sequence are identified in bold) | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPPCPAPEFEGGPSVFLFPPKPKDTLMISRTPE VTCVVVDVSQEDPEVQFNWYVDGVEVHNAKTKPREEQFNSTYRVVS VLTVLHQDWLNGKEYKCKVSNKGLPSSIEKTISKAKGQPREPQVYT LPPSQEEMTKNQVSLTCLVKGFYPSDIAVEWESNGQPENNYKTTPP VLDSDGSFFLYSRLTVDKSRWQEGNVFSCSVMHEALHNHYTQKSLS LSLGK |
| 200 | IgG4 heavy chain constant | Heavy Chain Constant Region | Gcctccaccaagggacctagcgtgttccctctcgcccctgttcca ggtccacaagcgagtccaccgctgccctcggctgtctggtgaaaga ctactttcccgagcccgtgaccgtctcctggaatagcggagccctg acctccggcgtgcacacatttcccgccgtgctgcagagcagcggac |

TABLE S1-continued

SEQ ID NOS: 1-342

| SEQ ID NO: | Name | Description | Sequence |
|---|---|---|---|
| | region-IgG4-PE | Nucleotide Sequence - Synthetic Version B | tgtatagcctgagcagcgtggtgaccgtgcccagctccagcctcgg caccaaaacctacacctgcaacgtggaccacaagccctccaacacc aaggtggacaagcgggtggagagcaagtacggcccccccttgccctc cttgtcctgccccctgagttcgagggaggaccctcgtgttcctgtt tccccccaaacccaaggacaccctgatgatctcccggacacccgag gtgacctgtgtggtcgtggacgtcagccaggaggaccccgaggtgc agttcaactggtatgtggacggcgtggaggtgcacaatgccaaaac caagcccagggaggagcagttcaattccacctacagggtggtgagc gtgctgaccgtcctgcatcaggattggctgaacggcaaggagtaca agtgcaaggtgtccaacaagggactgcccagctccatcgagaagac catcagcaaggctaagggccagccgagggagccccaggtgtatacc ctgcctcctagccaggaagagatgaccaagaaccaagtgtccctga cctgcctggtgaagggattctacccctccgacatcgccgtggagtg ggagagcaatggccagcccgagaacaactacaaaacaaccccctcc gtgctcgatagcgacggcagcttcttctctactacagccggctgacag tggacaagagcaggtggcaggagggcaacgtgttctcctgttccgt gatgcacgaggccctgcacaatcactacacccagaagagcctctcc ctgtccctgggcaag |
| 201 | IgG4 heavy chain constant region - IgG4-PE | Heavy Chain Constant Region Nucleotide Sequence - Synthetic Version C | gccagcaccaaggcccttccgtgttccccctggcccccttgcagca ggagcacctccgaatccacagctgccctgggctgtctggtgaagga ctacttccccgagcccgtgaccgtgagctggaacagcggcgctctg acatccggcgtccacaccttcctgccgtcctgcagtcctccggcc tctactccctgtcctccgtggtgaccgtgcctagctcctccctccg caccaagacctacacctgtaacgtggaccacaaaccctccaacacc aaggtggacaaacgggtcgagagcaagtacggccctcccctgccctc cttgtcctgccccctgagttcgaaggcggacccagcgtgttcctgtt ccctcctaagcccaaggacaccctcatgatcaagccggacacccgag gtgacctgcgtggtggtggatgtgagccaggaggaccctgaggtcc agttcaactggtatgtggatggcgtggaggtgcacaacgccaagac aaagccccgggaagagcagttcaactccacctacagggtggtcagc gtgctgaccgtgctgcatcaggactggctgaacggcaaggagtaca agtgcaaggtcagcaataagggactgcccagcagcatcgagaagac catctccaaggctaaaggccagccccgggaacctcaggtgtacacc ctgcctcccagccaggaggagatgaccaagaaccaggtgagcctga cctgcctggtgaagggattctaccctccgacatcgccgtggagtg ggagtccaacggccagcccgagaacaattataagaccaccccctcc gtcctcgacagcgacggatccttcttcctctgtactccaggctgaccg tggataagtccaggtggcaggaaggcaacgtgttcagctgctccgt gatgcacgaggccctgcacaatcactacacccagaagtccctgagc ctgtccctggggaaag |
| 202 | IgG4 heavy chain constant region | Heavy Chain Constant Region Nucleotide Sequence - Synthetic Version D | gcctccaccaagggcccatccgtcttccccctggcgccctgctcca ggagcacctccgagagcacggccgccctgggctgcctggtcaagga ctacttccccgaaccagtgacggtgtcgtggaactcaggcgccctg accagcggcgtgcacaccttcccggctgtcctacagtcctcaggac tctactccctcagcagcgtggtgaccgtgccctccagcagcttggg cacgaagacctacacctgcaacgtagatcacaagcccagcaacacc aaggtggacaagagagttgagtccaaatatggtcccccatgcccac catgcccagcgcctccagttgcggggggaccatcagtcttcctgtt ccccccaaaacccaaggacactctcatgatctcccggacccctgag gtcacgtgcgtggtggtggacgtgagccaggaagaccccgaggtcc agttcaactggtacgtggatggcgtggaggtgcataatgccaagac aaagccgcgggaggagcagttcaacagcacgtaccgtgtggtcagc gtcctcaccgtcctgcaccaggactggctgaacggcaaggagtaca agtgcaaggtctccaacaaaggcctcccgtcatcgatcgagaaaac catctccaaagccaaagggcagccccgagagccacaggtgtacacc ctgcccccatcccaggaggagatgaccaagaaccaggtcagcctga cctgcctggtcaaaggcttctaccccagcgacatcgccgtggagtg ggagagcaatgggcagccggagaacaactacaagaccacgcctccc gtgctggactccgacggatccttcttcctctacagcaggctaaccg tggacaagagcaggtggcaggaggggaatgtcttctcatgctccgt gatgcatgaggctctgcacaaccactacacacagaagagcctctcc ctgtctctgggtaaa |
| 203 | | Heavy Chain Constant Region Amino Acid Sequence - encoded by Synthetic Version D | ASTKGPSVFPLAPCSRSTSESTAALGCLVKDYFPEPVTVSWNSGAL TSGVHTFPAVLQSSGLYSLSSVVTVPSSSLGTKTYTCNVDHKPSNT KVDKRVESKYGPPCPPCPAPPVAGGPSVFLFPPKPKDTLMISRTPE VTCVVVDVSQEDPEVQFNWYVDGVEVHNAKTKPREEQFNSTYRVVS VLTVLHQDWLNGKEYKCKVSNKGLPSSIEKTISKAKGQPREPQVYT LPPSQEEMTKNQVSLTCLVKGFYPSDIAVEWESNGQPENNYKTTPP VLDSDGSFFLYSRLTVDKSRWQEGNVFSCSVMHEALHNHYTQKSLS LSLGK |

TABLE S1-continued

SEQ ID NOS: 1-342

| SEQ ID NO: | Name | Description | | Sequence |
|---|---|---|---|---|
| 204 | Disabled Human IgG1 heavy chain constant region | Disabled IGHG1 | Heavy Chain Constant Region Nucleotide Sequence | gcctccaccaagggcccatcggtcttccccctggcaccctcctcca agagcacctctgggggcacagcggccctgggctgcctggtcaagga ctacttccccgaaccggtgacggtgtcgtggaactcaggcgccctg accagcggcgtgcacaccttcccggctgtcctacagtcctcaggac tctactccctcagcagcgtggtgaccgtgccctccagcagcttggg cacccagacctacatctgcaacgtgaatcacaagcccagcaacacc aaggtggacaagaaagtggagcccaaatcttgtgacaaaactcaca catgcccaccgtgcccagcacctgaactcgcgggggcaccgtcagt cttcctcttccccccaaaacccaaggacaccctcatgatctcccgg acccctgaggtcacatgcgtggtggtggacgtgagccacgaagacc ctgaggtcaagttcaactggtacgtggacggcgtggaggtgcataa tgccaagacaaagccgcgggaggagcagtacaacagcacgtaccgt gtggtcagcgtcctcaccgtcctgcaccaggactggctgaatggca aggagtacaagtgcaaggtctccaacaaagccctcccagccccat cgagaaaaccatctccaaagccaaagggcagccccgagaaccacag gtgtacaccctgcccccatcccgggatgagctgaccaagaaccagg tcagcctgacctgcctggtcaaaggcttctatcccagcgacatcgc cgtggagtgggagagcaatgggcagccggagaacaactacaagacc acgcctcccgtgctggactccgacggctccttcttcctctacagca agctcaccgtggacaagagcaggtggcagcaggggaacgtcttctc atgctccgtgatgcatgaggctctgcacaaccactacacgcagaag agcctctccctgtctccgggtaaa |
| 205 | | | Heavy Chain Consant Region Amino Acid Sequence (Two residues that differ from the wild-type sequence are identified in bold) | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVEPKSCDKTHTCPPCPAPELAGAPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSRDELTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 206 | Human Cκ constant region | IGKC*01 | Cκ Light Chain Constant Region Nucleotide Sequence | cgtacggtggccgctcccctccgtgttcatcttcccaccttccgacg agcagctgaagtccggcaccgcttctgtcgtgtgcctgctgaacaa cttctaccccgcgaggccaaggtgcagtggaaggtggacaacgcc ctgcagtccggcaactcccaggaatccgtgaccgagcaggactcca aggacagcacctactctcctgtcctccaccctgaccctgtccaaggc cgactacgagaagcacaaggtgtacgcctgcgaagtgacccaccag ggcctgtctagccccgtgaccaagtctttcaaccggggcgagtgt |
| 207 | | | Cκ Light Chain Constant Region Amino Acid Sequence | RTVAAPSVFIFPPSDEQLKSGTASVVCLLNNFYPREAKVQWKVDNA LQSGNSQESVTEQDSKDSTYSLSSTLTLSKADYEKHKVYACEVTHQ GLSSPVTKSFNRGEC |
| 208 | Human Cκ constant region | IGKC*02 | Cκ Light Chain Constant Region Nucleotide Sequence | cgaactgtggctgcaccatctgtcttcatcttcccgccatctgatg agcagttgaaatctggaactgcctctgttgtgtgcctgctgaataa cttctatcccagagaggccaaagtacagtggaaggtggataacgcc ctccaatcgggtaactcccaggagagtgtcacagagcaggagagca aggacagcacctacagcctcagcagcaccctgacgctgagcaaagc agactacgagaaacacaaagtctacgccggcgaagtcacccatcag ggcctgagctcgcccgtcacaaagagcttcaacaggggagagtgt |
| 209 | | | Cκ Light Chain Constant Region Amino Acid Sequence | RTVAAPSVFIFPPSDEQLKSGTASVVCLLNNFYPREAKVQWKVDNA LQSGNSQESVTEQESKDSTYSLSSTLTLSKADYEKHKVYAGEVTHQ GLSSPVTKSFNRGEC |
| 210 | Human Cκ constant region | IGKC*03 | Cκ Light Chain Constant Region Nucleotide | cgaactgtggctgcaccatctgtcttcatcttcccgccatctgatg agcagttgaaatctggaactgcctctgttgtgtgcctgctgaataa cttctatcccagagaggccaaagtacagcggaaggtggataacgcc ctccaatcgggtaactcccaggagagtgtcacagagcaggagagca aggacagcacctacagcctcagcagcaccctgacgctgagcaaagc |

TABLE S1-continued

SEQ ID NOS: 1-342

| SEQ ID NO: | Name | | Description | Sequence |
|---|---|---|---|---|
| | | | Sequence | agactacgagaaacacaaagtctacgcctgcgaagtcacccatcag ggcctgagctcgcccgtcacaaagagcttcaacaggggagagtgt |
| 211 | | | Cκ Light Chain Constant Region Amino Acid Sequence | RTVAAPSVFIFPPSDEQLKSGTASVVCLLNNFYPREAKVQRKVDNA LQSGNSQESVTEQESKDSTYSLSSTLTLSKADYEKHKVYACEVTHQ GLSSPVTKSFNRGEC |
| 212 | Human Cκ constant region | IGKC*04 | Cκ Light Chain Constant Region Nucleotide Sequence | cgaactgtggctgcaccatctgtcttcatcttcccgccatctgatg agcagttgaaatctggaactgcctctgttgtgtgcctgctgaataa cttctatcccagagaggccaaagtacagtggaaggtggataacgcc ctccaatcgggtaactcccaggagagtgtcacagagcaggacagca aggacagcacctacagcctcagcagcaccctgacgctgagcaaagc agactacgagaaacacaaactctacgcctgcgaagtcacccatcag ggcctgagctcgcccgtcacaaagagcttcaacaggggagagtgt |
| 213 | | | Cκ Light Chain Constant Region Amino Acid Sequence | RTVAAPSVFIFPPSDEQLKSGTASVVCLLNNFYPREAKVQWKVDNA LQSGNSQESVTEQDSKDSTYSLSSTLTLSKADYEKHKLYACEVTHQ GLSSPVTKSFNRGEC |
| 214 | Human Cκ constant region | IGKC*05 | Cκ Light Chain Constant Region Nucleotide Sequence | cgaactgtggctgcaccatctgtcttcatcttcccgccatctgatg agcagttgaaatctggaactgcctctgttgtgtgcctgctgaataa cttctatcccagagaggccaaagtacagtggaaggtggataacgcc ctccaatcgggtaactcccaggagagtgtcacagagcaggacagca aggacagcacctacagcctcagcaacaccctgacgctgagcaaagc agactacgagaaacacaaagtctacgcctgcgaagtcacccatcag ggcctgagctcgcccgtcacaaagagcttcaacaggggagagtgc |
| 215 | | | Cκ Light Chain Constant Region Amino Acid Sequence | RTVAAPSVFIFPPSDEQLKSGTASVVCLLNNFYPREAKVQWKVDNA LQSGNSQESVTEQDSKDSTYSLSNTLTLSKADYEKHKVYACEVTHQ GLSSPVTKSFNRGEC |
| 216 | Human Cλ constant region | IGCλ1*01 | Cλ Light Chain Constant Region Nucleotide Sequence | cccaaggccaaccccacggtcactctgttcccgccctcctctgagg agctccaagccaacaaggccacactagtgtgtctgatcagtgactt ctacccgggagctgtgacagtggcttggaaggcagatggcagcccc gtcaaggcgggagtggagaccaccaaaccctccaaacagagcaaca acaagtacgcggccagcagctacctgagcctgacgcccgagcagtg gaagtcccacagaagctacagctgccaggtcacgcatgaagggagc accgtggagaagacagtggcccctacagaatgttca |
| 217 | | | Cλ Light Chain Constant Region Amino Acid Sequence | PKANPTVTLFPPSSEELQANKATLVCLISDFYPGAVTVAWKADGSP VKAGVETTKPSKQSNNKYAASSYLSLTPEQWKSHRSYSCQVTHEGS TVEKTVAPTECS |
| 218 | Human Cλ constant region | IGCλ1*02 | Cλ Light Chain Constant Region Nucleotide Sequence | ggtcagcccaaggccaaccccactgtcactctgttcccgccctcct ctgaggagctccaagccaacaaggccacactagtgtgtctgatcag tgacttctacccgggagctgtgacagtggcctggaaggcagatggc agccccgtcaaggcgggagtggagaccaccaaaccctccaaacaga gcaacaacaagtacgcggccagcagctacctgagcctgacgcccga gcagtggaagtcccacagaagctacagctgccaggtcacgcatgaa gggagcaccgtggagaagacagtggcccctacagaatgttca |
| 219 | | | Cλ Light Chain Constant Region Amino Acid Sequence | GQPKANPTVTLFPPSSEELQANKATLVCLISDFYPGAVTVAWKADG SPVKAGVETTKPSKQSNNKYAASSYLSLTPEQWKSHRSYSCQVTHE GSTVEKTVAPTECS |
| 220 | Human Cλ constant region | IGCλ2*01 | Cλ Light Chain Constant Region | ggtcagcccaaggccaaccccactgtcactctgttcccgccctcct ctgaggagctccaagccaacaaggccacactagtgtgtctgatcag tgacttctacccgggagctgtgacagtggcctggaaggcagatggc agccccgtcaaggcgggagtggagaccaccaaaccctccaaacaga |

TABLE S1-continued

SEQ ID NOS: 1-342

| SEQ ID NO: | Name | Description | Sequence |
|---|---|---|---|
| | | Nucleotide Sequence - Version A | gcaacaacaagtacgcggccagcagctacctgagcctgacgcccga gcagtggaagtcccacagaagctacagctgccaggtcacgcatgaa gggagcaccgtggagaagacagtggcccctacagaatgttca |
| 221 | | Cλ Light Chain Constant Region Nucleotide Sequence - Version B | ggccagcctaaggccgctccttctgtgaccctgttcccccccatcct ccgaggaactgcaggctaacaaggccaccctcgtgtgcctgatcag cgacttctaccctggcgccgtgaccgtggcctggaaggctgatagc tctcctgtgaaggccggcgtggaaaccaccacccccttccaagcagt ccaacaacaaatacgccgcctcctcctacctgtccctgaccccctga gcagtggaagtcccaccggtcctacagctgccaagtgacccacgag ggctccaccgtggaaaagaccgtggcctcctaccgagtgctcc |
| 222 | | Cλ Light Chain Constant Region Nucleotide Sequence - Version C | ggccagcctaaagctgcccccagcgtcacccctgtttcctccctcca gcgaggagctccaggccaacaaggccaccctcgtgtgcctgatctc cgacttctatcccggcgctgtgaccgtggcttggaaagccgactcc agccctgtcaaagccggcgtggagaccaccacaccctccaagcagt ccaacaacaagtacgccgcctccagctatctctcccctgacccctga gcagtggaagtcccaccggtcctactcctgtcaggtgacccacgag ggctccaccgtggaaaagaccgtcgcccccaccgagtgctcc |
| 223 | | Cλ Light Chain Constant Region Amino Acid Sequence - Encoded by Version A, B & C | GQPKANPTVTLFPPSSEELQANKATLVCLISDFYPGAVTVAWKADG SPVKAGVETTKPSKQSNNKYAASSYLSLTPEQWKSHRSYSCQVTHE GSTVEKTVAPTECS |
| 224 | Human Cλ constant region | IGCλ2*02 & IGLC2*03 Cλ Light Chain Constant Region Nucleotide Sequence | ggtcagcccaaggctgcccctcggtcactctgttcccgcccctcct ctgaggagcttcaagccaacaaggccacactggtgtgtctcataag tgacttctacccgggagccgtgacagtggcctggaaggcagatagc agccccgtcaaggcgggagtggagaccaccacaccctcaaacaaa gcaacaacaagtacgcggccagcagctatctgagcctgacgcctga gcagtggaagtcccacagaagctacagctgccaggtcacgcatgaa gggagcaccgtggagaagacagtggcccctacagaatgttca |
| 225 | | Cλ Light Chain Constant Region Amino Acid Sequence | GQPKAAPSVTLFPPSSEELQANKATLVCLISDFYPGAVTVAWKADS SPVKAGVETTTPSKQSNNKYAASSYLSLTPEQWKSHRSYSCQVTHE GSTVEKTVAPTECS |
| 226 | Human Cλ constant region | IGCλ3*01 Cλ Light Chain Constant Region Nucleotide Sequence | cccaaggctgcccctcggtcactctgttcccaccctcctctgagg agcttcaagccaacaaggccacactggtgtgtctcataagtgactt ctacccgggagccgtgacagttgcctggaaggcagatagcagccc gtcaaggcgggggtggagaccaccacaccctccaaacaaagcaaca caagtacgcggccagcagctacctgagcctgacgcctgagcagtg gaagtcccacaaaagctacagctgccaggtcacgcatgaagggagc accgtggagaagacagttgcccctacggaatgttca |
| 227 | | Cλ Light Chain Constant Region Amino Acid Sequence | PKAAPSVTLFPPSSEELQANKATLVCLISDFYPGAVTVAWKADSSP VKAGVETTTPSKQSNNKYAASSYLSLTPEQWKSHKSYSCQVTHEGS TVEKTVAPTECS |
| 228 | Human Cλ constant region | IGCλ3*02 Cλ Light Chain Constant Region Nucleotide Sequence | ggtcagcccaaggctgcccctcggtcactctgttcccaccctcct ctgaggagcttcaagccaacaaggccacactggtgtgtctcataag tgacttctacccggggccagtgacagttgcctgaaggcagatagc agccccgtcaaggcgggggtggagaccaccacaccctccaaacaaa gcaacaacaagtacgcggccagcagctacctgagcctgacgcctga gcagtggaagtcccacaaaagctacagctgccaggtcacgcatgaa gggagcaccgtggagaagacagtggcccctacggaatgttca |
| 229 | | Cλ Light Chain Constant Region Amino Acid Sequence | GQPKAAPSVTLFPPSSEELQANKATLVCLISDFYPGPVTVAWKADS SPVKAGVETTTPSKQSNNKYAASSYLSLTPEQWKSHKSYSCQVTHE GSTVEKTVAPTECS |

TABLE S1-continued

SEQ ID NOS: 1-342

| SEQ ID NO: | Name | Description | Sequence |
|---|---|---|---|
| 230 | Human Cλ constant region | IGCλ3*03 Cλ Light Chain Constant Region Nucleotide Sequence | ggtcagcccaaggctgccccctcggtcactctgttcccaccctcct ctgaggagcttcaagccaacaaggccacactggtgtgtctcataag tgacttctacccgggagccgtgacagtggcctggaaggcagatagc agccccgtcaaggcgggagtggagaccaccacaccctccaaacaaa gcaacaacaagtacgcggccagcagctacctgagcctgacgcctga gcagtggaagtcccacaaaagctacagctgccaggtcacgcatgaa gggagcaccgtggagaagacagtggcccctacagaatgttca |
| 231 | | Cλ Light Chain Constant Region Amino Acid Sequence | GQPKAAPSVTLFPPSSEELQANKATLVCLISDFYPGAVTVAWKADS SPVKAGVETTTPSKQSNNKYAASSYLSLTPEQWKSHKSYSCQVTHE GSTVEKTVAPTECS |
| 232 | Human Cλ constant region | IGCλ3*04 Cλ Light Chain Constant Region Nucleotide Sequence | ggtcagcccaaggctgccccctcggtcactctgttcccgccctcct ctgaggagcttcaagccaacaaggccacactggtgtgtctcataag tgacttctacccgggagccgtgacagtggcctggaaggcagatagc agccccgtcaaggcgggagtggagaccaccacaccctccaaacaaa gcaacaacaagtacgcggccagcagctacctgagcctgacgcctga gcagtggaagtcccacagaagctacagctgccaggtcacgcatgaa gggagcaccgtggagaagacagtggcccctacagaatgttca |
| 233 | | Cλ Light Chain Constant Region Amino Acid Sequence | GQPKAAPSVTLFPPSSEELQANKATLVCLISDFYPGAVTVAWKADS SPVKAGVETTTPSKQSNNKYAASSYLSLTPEQWKSHRSYSCQVTHE GSTVEKTVAPTECS |
| 234 | Human Cλ constant region | IGCλ6*01 Cλ Light Chain Constant Region Nucleotide Sequence | ggtcagcccaaggctgcccccatcggtcactctgttcccgccctcct ctgaggagcttcaagccaacaaggccacactggtgtgcctgatcag tgacttctacccgggagctgtgaaagtggcctggaaggcagatggc agccccgtcaacacgggagtggagaccaccacaccctccaaacaga gcaacaacaagtacgcggccagcagctacctgagcctgacgcctga gcagtggaagtcccacagaagctacagctgccaggtcacgcatgaa gggagcaccgtggagaagacagtggcccctgcagaatgttca |
| 235 | | Cλ Light Chain Constant Region Amino Acid Sequence | GQPKAAPSVTLFPPSSEELQANKATLVCLISDFYPGAVKVAWKADG SPVNTGVETTTPSKQSNNKYAASSYLSLTPEQWKSHRSYSCQVTHE GSTVEKTVAPAECS |
| 236 | Human Cλ constant region | IGLC7*01 & IGCλ7*02 Cλ Light Chain Constant Region Nucleotide Sequence | ggtcagcccaaggctgcccccatcggtcactctgttcccaccctcct ctgaggagcttcaagccaacaaggccacactggtgtgtctcgtaag tgacttctacccgggagccgtgacagtggcctggaaggcagatagc agccccgtcaaggtgggagtggagaccaccaaaccctccaaacaaa gcaacaacaagtatgcggccagcagctacctgagcctgacgcccga gcagtggaagtcccacagaagctacagctgccgggtcacgcatgaa gggagcaccgtggagaagacagtggcccctgcagaatgctct |
| 237 | | Cλ Light Chain Constant Region Amino Acid Sequence | GQPKAAPSVTLFPPSSEELQANKATLVCLVSDFYPGAVTVAWKADG SPVKVGVETTKPSKQSNNKYAASSYLSLTPEQWKSHRSYSCRVTHE GSTVEKTVAPAECS |
| 238 | 413G05 - CDRH1 (IMGT) | Amino acid sequence of CDRH1 of 413G05 using IMGT | GFTFSDYY |
| 239 | 413G05 - CDRH2 (IMGT) | Amino acid sequence of CDRH2 of 413G05 using IMGT | ISTSGSTI |

TABLE S1-continued

SEQ ID NOS: 1-342

| SEQ ID NO: | Name | Description | Sequence |
|---|---|---|---|
| 240 | 413G05 - CDRH3 (IMGT) | Amino acid sequence of CDRH3 of 413G05 using IMGT | ARGITGTNFYHYGLGV |
| 241 | 413G05 - CDRH1 (Kabat) | Amino acid sequence of CDRH1 of 413G05 using Kabat | DYYMS |
| 242 | 413G05 - CDRH2 (Kabat) | Amino acid sequence of CDRH2 of 413G05 using Kabat | YISTSGSTIYYADSVKG |
| 243 | 413G05 - CDRH3 (Kabat) | Amino acid sequence of CDRH3 of 413G05 using Kabat | GITGTNFYHYGLGV |
| 244 | 413G05 - Heavy chain variable region | Amino acid sequence of $V_H$ of 413G05 | QVQLVESGGGLVKPGGSLRLSCAASGFTFSDYYMSWIRQVPGKGLE WVSYISTSGSTIYYADSVKGRFTISRDNAKNSLYLQMNSLRAEDAA VYHCARGITGTNFYHYGLGVWGQGTTVTVSS |
| 245 | 413G05 - Heavy chain variable region | Nucleic acid sequence of $V_H$ of 413G05 | CAGGTGCAGCTGGTGGAGTCTGGGGGAGGCTTGGTCAAGCCTGGAG GGTCCCTGAGACTCTCCTGTGCAGCCTCTGGATTCACCTTCAGTGA CTACTACATGAGCTGGATCCGCCAGGTTCCAGGGAAGGGGCTGGAG TGGGTTTCATACATTAGTACTAGTGGTAGTACCATATACTACGCAG ACTCTGTGAAGGGCCGATTCACCATCTCCAGGGACAACGCCAAGAA CTCACTGTATCTACAAATGAACAGCCTGAGAGCCGAGGACGCGGCC GTGTATCACTGTGCGAGAGGTATAACTGGAACTAACTTCTACCACT ACGGTTTGGGCGTCTGGGGCCAAGGGACCACGGTCACCGTCTCCTC AG |
| 246 | 413G05 - full heavy chain sequence | Amino acid sequence of 413G05 heavy chain | QVQLVESGGGLVKPGGSLRLSCAASGFTFSDYYMSWIRQVPGKGLE WVSYISTSGSTIYYADSVKGRFTISRDNAKNSLYLQMNSLRAEDAA VYHCARGITGTNFYHYGLGVWGQGTTVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKKVEPKSCDKTH TCPPCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSRDELTKNQ VSLTCLVKGFYPSDIAVEWESNGQPENNYKTTPPVLDSDGSFFLYS KLTVDKSRWQQGNVFSCSVMHEALHNHYTQKSLSLSPGK |
| 247 | 413G05 - full heavy chain sequence | Nucleic acid sequence of 413G05 heavy chain | CAGGTGCAGCTGGTGGAGTCTGGGGGAGGCTTGGTCAAGCCTGGAG GGTCCCTGAGACTCTCCTGTGCAGCCTCTGGATTCACCTTCAGTGA CTACTACATGAGCTGGATCCGCCAGGTTCCAGGGAAGGGGCTGGAG TGGGTTTCATACATTAGTACTAGTGGTAGTACCATATACTACGCAG ACTCTGTGAAGGGCCGATTCACCATCTCCAGGGACAACGCCAAGAA CTCACTGTATCTACAAATGAACAGCCTGAGAGCCGAGGACGCGGCC GTGTATCACTGTGCGAGAGGTATAACTGGAACTAACTTCTACCACT ACGGTTTGGGCGTCTGGGGCCAAGGGACCACGGTCACCGTCTCCTC AGCCAGCACCAAGGGCCCCTCTGTGTTCCCTCTGGCCCCTTCCAGC AAGTCCACCTCTGGCGGAACAGCCGCTCTGGGCTGCCTCGTGAAGG ACTACTTCCCCGAGCCTGTGACCGTGTCCTGGAACTCTGGCGCTCT GACCAGCGGAGTGCACACCTTCCCTGCTGTGCTGCAGTCCTCCGGC CTGTACTCCCTGTCCTCCGTCGTGACCGTGCCTTCCAGCTCTCTGG GCACCCAGACCTACATCTGCAACGTGAACCACAAGCCCTCCAACAC CAAGGTGGACAAGAAGGTGGAACCCAAGTCCTGCGACAAGACCCAC ACCTGTCCCCCTTGTCCTGCCCCTGAACTGCTGGGCGGACCTTCCG TGTTCCTGTTCCCCCCAAAGCCCAAGGACACCCTGATGATCTCCCG GACCCCCGAAGTGACCTGCGTGGTGGTGGATGTGTCCCACGAGGAC CCTGAAGTGAAGTTCAATTGGTACGTGGACGGCGTGGAAGTGCACA ACGCCAAGACCAAGCCTAGAGAGGAACAGTACAACTCCACCTACCG GGTGGTGTCCGTGCTGCTGCACCAGGATTGGCTGAACGGC AAAGAGTACAAGTGCAAGGTGTCCAACAAGGCCCTGCCTGCCCCCA TCGAAAAGACCATCTCCAAGGCCAAGGGCCAGCCCCGGGAACCCCA GGTGTACACACTGCCCCCTAGCAGGGACGAGCTGACCAAGAACCAG GTGTCCCTGACCTGTCTCGTGAAAGGCTTCTACCCCTCCGATATCG CCGTGGAATGGGAGTCAACGGCCAGCCTGAGAACAACTACAAGAC |

TABLE S1-continued

SEQ ID NOS: 1-342

| SEQ ID NO:Name | Description | Sequence |
|---|---|---|
| | | CACCCCCCCTGTGCTGGACTCCGACGGCTCATTCTTCCTGTACAGC<br>AAGCTGACAGTGGACAAGTCCCGGTGGCAGCAGGGCAACGTGTTCT<br>CCTGCTCCGTGATGCACGAGGCCCTGCACAACCACTACACCCAGAA<br>GTCCCTGTCCCTGAGCCCCGGCAAG |
| 248 413G05 - CDRL1 (IMGT) | Amino acid sequence of CDRL1 of 413G05 using IMGT | QGINSW |
| 249 413G05 - CDRL2 (IMGT) | Amino acid sequence of CDRL2 of 413G05 using IMGT | AAS |
| 250 413G05 - CDRL3 (IMGT) | Amino acid sequence of CDRL3 of 413G05 using IMGT | QQVNSFPLT |
| 251 413G05 - CDRL1 (Kabat) | Amino acid sequence of CDRL1 of 413G05 using Kabat | RASQGINSWLA |
| 252 413G05 - CDRL2 (Kabat) | Amino acid sequence of CDRL2 of 413G05 using Kabat | AASTLQS |
| 253 413G05 - CDRL3 (Kabat) | Amino acid sequence of CDRL3 of 413G05 using Kabat | QQVNSFPLT |
| 254 413G05 - Light chain variable region | Amino acid sequence of $V_L$ of 413G05 | DIQMTQSPSSVSASVGDRVTITCRASQGINSWLAWYQQKPGKAPKL<br>LIYAASTLQSGVPSRFSGSGSGADFTLTISSLQPEDFATYYCQQVN<br>SFPLTFGGGTKVEIK |
| 255 413G05 - Light chain variable region | Nucleic acid sequence of $V_L$ of 413G05 | GACATCCAGATGACCCAGTCTCCATCTTCCGTGTCTGCATCTGTAG<br>GAGACAGAGTCACCATCACTTGTCGGGCGAGTCAGGGTATTAACAG<br>CTGGTTAGCCTGGTATCAGCAGAAACCAGGGAAAGCCCCTAAGCTC<br>CTGATCTATGCTGCATCCACTTTGCAAAGTGGGGTCCCATCAAGGT<br>TCAGCGGCAGTGGGTCTGGGGCAGATTTCACTCTCACCATCAGCAG<br>CCTGCAGCCTGAAGATTTTGCAACTTACTATTGTCAACAGGTTAAC<br>AGTTTCCCGCTCACTTTCGGCGGAGGGACCAAGGTGGAGATCAAAC |
| 256 413G05 - full light chain sequence | Amino acid sequence of 413G05 light chain | DIQMTQSPSSVSASVGDRVTITCRASQGINSWLAWYQQKPGKAPKL<br>LIYAASTLQSGVPSRFSGSGSGADFTLTISSLQPEDFATYYCQQVN<br>SFPLTFGGGTKVEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 257 413G05 - full light chain sequence | Nucleic acid sequence of 413G05 light chain | GACATCCAGATGACCCAGTCTCCATCTTCCGTGTCTGCATCTGTAG<br>GAGACAGAGTCACCATCACTTGTCGGGCGAGTCAGGGTATTAACAG<br>CTGGTTAGCCTGGTATCAGCAGAAACCAGGGAAAGCCCCTAAGCTC<br>CTGATCTATGCTGCATCCACTTTGCAAAGTGGGGTCCCATCAAGGT<br>TCAGCGGCAGTGGGTCTGGGGCAGATTTCACTCTCACCATCAGCAG<br>CCTGCAGCCTGAAGATTTTGCAACTTACTATTGTCAACAGGTTAAC<br>AGTTTCCCGCTCACTTTCGGCGGAGGGACCAAGGTGGAGATCAAAC<br>GTACGGTGGCCGCTCCCTCCGTGTTCATCTTCCCACCTTCCGACGA<br>GCAGCTGAAGTCCGGCACCGCTTCTGTCGTGTGCCTGCTGAACAAC<br>TTCTACCCCCGCGAGGCCAAGGTGCAGTGGAAGGTGGACAACGCCC<br>TGCAGTCCGGCAACTCCCAGGAATCCGTGACCGAGCAGGACTCCAA<br>GGACAGCACCTACTCCCTGTCCTCCACCCTGACCCTGTCCAAGGCC<br>GACTACGAGAAGCACAAGGTGTACGCCTGCGAAGTGACCCACCAGG<br>GCCTGTCTAGCCCCGTGACCAAGTCTTTCAACCGGGGCGAGTGT |
| 258 413F09 - CDRH1 (IMGT) | Amino acid sequence of CDRH1 of 413F09 using IMGT | GFTFSYYA |

TABLE S1-continued

SEQ ID NOS: 1-342

| SEQ ID NO:Name | Description | Sequence |
|---|---|---|
| 259 413F09 - CDRH2 (IMGT) | Amino acid sequence of CDRH2 of 413F09 using IMGT | ISGGGGNT |
| 260 413F09 - CDRH3 (IMGT) | Amino acid sequence of CDRH3 of 413F09 using IMGT | AKDRMKQLVRAYYFDY |
| 261 413F09 - CDRH1 (Kabat) | Amino acid sequence of CDRH1 of 413F09 using Kabat | YYAMS |
| 262 413F09 - CDRH2 (Kabat) | Amino acid sequence of CDRH2 of 413F09 using Kabat | TISGGGGNTHYADSVKG |
| 263 413F09 - CDRH3 (Kabat) | Amino acid sequence of CDRH3 of 413F09 using Kabat | DRMKQLVRAYYFDY |
| 264 413F09 Heavy chain variable region | Amino acid sequence of $V_H$ of 413F09 | EVPLVESGGGLVQPGGSLRLSCAASGFTFSYYAMSWVRQAPGKGLD WVSTISGGGGNTHYADSVKGRFTISRDNSKNTLYLHMNSLRAEDTA VYYCAKDRMKQLVRAYYFDYWGQGTLVTVSS |
| 265 413F09 Heavy chain variable region | Nucleic acid sequence of $V_H$ of 413F09 | GAGGTGCCGCTGGTGGAGTCTGGGGGAGGCTTGGTACAGCCTGGGG GGTCCCTGAGACTCTCCTGTGCAGCCTCTGGATTCACGTTTAGCTA CTATGCCATGAGCTGGGTCCGTCAGGCTCCAGGGAAGGGGCTGGAC TGGGTCTCAACTATTAGTGGTGGTGGTGGTAACACACACTACGCAG ACTCCGTGAAGGGCCGATTCACTATATCCAGAGACAATTCCAAGAA CACGCTGTATCTGCACATGAACAGCCTGAGAGCCGAAGACACGGCC GTCTATTACTGTGCGAAGGATCGGATGAAACAGCTCGTCCGGGCCT ACTACTTTGACTACTGGGGCCAGGGAACCCTGGTCACCGTCTCCTC AG |
| 266 413F09 - full heavy chain sequence | Amino acid sequence of 413F09 heavy chain | EVPLVESGGGLVQPGGSLRLSCAASGFTFSYYAMSWVRQAPGKGLD WVSTISGGGGNTHYADSVKGRFTISRDNSKNTLYLHMNSLRAEDTA VYYCAKDRMKQLVRAYYFDYWGQGTLVTVSSASTKGPSVFPLAPSS KSTSGGTAALGCLVKDYFPEPVTVSWNSGALTSGVHTFPAVLQSSG LYSLSSVVTVPSSSLGTQTYICNVNHKPSNTKVDKKVEPKSCDKTH TCPPCPAPELLGGPSVFLFPPKPKDTLMISRTPEVTCVVVDVSHED PEVKFNWYVDGVEVHNAKTKPREEQYNSTYRVVSVLTVLHQDWLNG KEYKCKVSNKALPAPIEKTISKAKGQPREPQVYTLPPSRDELTKNQ VSLTCLVKGFYPSDIAVEWESNGQPENNYKTTPPVLDSDGSFFLYS KLTVDKSRWQQGNVFSCSVMHEALHNHYTQKSLSLSPGK |
| 267 413F09 - full heavy chain sequence | Nucleic acid sequence of 413F09 heavy chain | GAGGTGCCGCTGGTGGAGTCTGGGGGAGGCTTGGTACAGCCTGGGG GGTCCCTGAGACTCTCCTGTGCAGCCTCTGGATTCACGTTTAGCTA CTATGCCATGAGCTGGGTCCGTCAGGCTCCAGGGAAGGGGCTGGAC TGGGTCTCAACTATTAGTGGTGGTGGTGGTAACACACACTACGCAG ACTCCGTGAAGGGCCGATTCACTATATCCAGAGACAATTCCAAGAA CACGCTGTATCTGCACATGAACAGCCTGAGAGCCGAAGACACGGCC GTCTATTACTGTGCGAAGGATCGGATGAAACAGCTCGTCCGGGCCT ACTACTTTGACTACTGGGGCCAGGGAACCCTGGTCACCGTCTCCTC AGCCAGCACCAAGGGCCCCTCTGTGTTCCCTCTGGCCCCTTCCAGC AAGTCCACCTCTGGCGGAACAGCCGCTCTGGGCTGCCTCGTGAAGG ACTACTTCCCCGAGCCTGTGACCGTGTCCTGGAACTCTGGCGCTCT GACCAGCGGAGTGCACACCTTCCCTGCTGTGCTGCAGTCCTCCGGC CTGTACTCCCTGTCCTCCGTCGTGACCGTGCCTTCCAGCTCTCTGG GCACCCAGACCTACATCTGCAACGTGAACCACAAGCCCTCCAACAC CAAGGTGGACAAGAAGGTGGAACCCAAGTCCTGCGACAAGACCCAC ACCTGTCCCCCTTGTCCTGCCCCTGAACTGCTGGGCGGACCTTCCG TGTTCCTGTTCCCCCCAAAGCCCAAGGACACCCTGATGATCTCCCG GACCCCCGAAGTGACCTGCGTGGTGGTGGATGTGTCCCACGAGGAC CCTGAAGTGAAGTTCAATTGGTACGTGGACGGCGTGGAAGTGCACA ACGCCAAGACCAAGCCTAGAGAGGAACAGTACAACTCCACCTACCG GGTGGTGTCCGTGCTGACCGTGCTGCACCAGGATTGGCTGAACGGC |

TABLE S1-continued

SEQ ID NOS: 1-342

| SEQ ID NO: | Name | Description | Sequence |
|---|---|---|---|
| | | | AAAGAGTACAAGTGCAAGGTGTCCAACAAGGCCCTGCCTGCCCCA<br>TCGAAAAGACCATCTCCAAGGCCAAGGGCCAGCCCCGGGAACCCCA<br>GGTGTACACACTGCCCCCTAGCAGGGACGAGCTGACCAAGAACCAG<br>GTGTCCCTGACCTGTCTCGTGAAAGGCTTCTACCCCTCCGATATCG<br>CCGTGGAATGGGAGTCCAACGGCCAGCCTGAGAACAACTACAAGAC<br>CACCCCCCCTGTGCTGGACTCCGACGGCTCATTCTTCCTGTACAGC<br>AAGCTGACAGTGGACAAGTCCCGGTGGCAGCAGGGCAACGTGTTCT<br>CCTGCTCCGTGATGCACGAGGCCCTGCACAACCACTACACCCAGAA<br>GTCCCTGTCCCTGAGCCCCGGCAAG |
| 268 | 413F09 - CDRL1 (IMGT) | Amino acid sequence of CDRL1 of 413F09 using IMGT | QDISTY |
| 269 | 413F09 - CDRL2 (IMGT) | Amino acid sequence of CDRL2 of 413F09 using IMGT | GTS |
| 270 | 413F09 - CDRL3 (IMGT) | Amino acid sequence of CDRL3 of 413F09 using IMGT | QQLHTDPIT |
| 271 | 413F09 - CDRL1 (Kabat) | Amino acid sequence of CDRL1 of 413F09 using Kabat | WASQDISTYLG |
| 272 | 413F09 - CDRL2 (Kabat) | Amino acid sequence of CDRL2 of 413F09 using Kabat | GTSSLQS |
| 273 | 413F09 - CDRL3 (Kabat) | Amino acid sequence of CDRL3 of 413F09 using Kabat | QQLHTDPIT |
| 274 | 413F09 - Light chain variable region | Amino acid sequence of $V_L$ of 413F09 | DIQLTQSPSFLSASVGDRVTITCWASQDISTYLGWYQQKPGKAPKL<br>LIYGTSSLQSGVPSRFSGSGSGTEFTLTISSLQPEDFATYYCQQLH<br>TDPITFGQGTRLEIK |
| 275 | 413F09 - Light chain variable region | Nucleic acid sequence of $V_L$ of 413F09 | GACATCCAGTTGACCCAGTCTCCATCCTTCCTGTCTGCATCTGTAG<br>GAGACAGAGTCACCATCACTTGCTGGGCCAGTCAGGACATTAGCAC<br>TTATTTAGGCTGGTATCAGCAAAAACCAGGGAAAGCCCCTAAGCTC<br>CTGATCTATGGTACATCCAGTTTGCAAAGTGGGGTCCCATCAAGGT<br>TCAGCGGCAGTGGATCTGGGACAGAATTCACTCTCACAATCAGCAG<br>CCTGCAGCCTGAAGATTTTGCAACTTATTACTGTCAACAGCTTCAT<br>ACTGACCCGATCACCTTCGGCCAAGGGACACGACTGGAGATCAAAC |
| 276 | 413F09 - full light chain sequence | Amino acid sequence of 413F09 light chain | DIQLTQSPSFLSASVGDRVTITCWASQDISTYLGWYQQKPGKAPKL<br>LIYGTSSLQSGVPSRFSGSGSGTEFTLTISSLQPEDFATYYCQQLH<br>TDPITFGQGTRLEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 277 | 413F09 - full light chain sequence | Nucleic acid sequence of 413F09 light chain | GACATCCAGTTGACCCAGTCTCCATCCTTCCTGTCTGCATCTGTAG<br>GAGACAGAGTCACCATCACTTGCTGGGCCAGTCAGGACATTAGCAC<br>TTATTTAGGCTGGTATCAGCAAAAACCAGGGAAAGCCCCTAAGCTC<br>CTGATCTATGGTACATCCAGTTTGCAAAGTGGGGTCCCATCAAGGT<br>TCAGCGGCAGTGGATCTGGGACAGAATTCACTCTCACAATCAGCAG<br>CCTGCAGCCTGAAGATTTTGCAACTTATTACTGTCAACAGCTTCAT<br>ACTGACCCGATCACCTTCGGCCAAGGGACACGACTGGAGATCAAAC<br>GTACGGTGGCCGCTCCCTCCGTGTTCATCTTCCCACCTTCCGACGA<br>GCAGCTGAAGTCCGGCACCGCTTCTGTCGTGTGCCTGCTGAACAAC<br>TTCTACCCCCGCGAGGCCAAGGTGCAGTGGAAGGTGGACAACGCCC<br>TGCAGTCCGGCAACTCCCAGGAATCCGTGACCGAGCAGGACTCCAA<br>GGACAGCACCTACTCCCTGTCCTCCACCCTGACCCTGTCCAAGGCC<br>GACTACGAGAAGCACAAGGTGTACGCCTGCGAAGTGACCCACCAGG<br>GCCTGTCTAGCCCCGTGACCAAGTCTTTCAACCGGGGCGAGTGT |

TABLE S1-continued

SEQ ID NOS: 1-342

| SEQ ID NO:Name | Description | Sequence |
|---|---|---|
| 278 414B06 - CDRH1 (IMGT) | Amino acid sequence of CDRH1 of 414306 using IMGT | GFTFSSYW |
| 279 414B06 - CDRH2 (IMGT) | Amino acid sequence of CDRH2 of 414306 using IMGT | IKQDGSEK |
| 280 414306 - CDRH3 (IMGT) | Amino acid sequence of CDRH3 of 414B06 using IMGT | ARVRQWSDYSDY |
| 281 414306 - CDRH1 (Kabat) | Amino acid sequence of CDRH1 of 414B06 using Kabat | SYWMN |
| 282 414306 - CDRH2 (Kabat) | Amino acid sequence of CDRH2 of 414B06 using Kabat | NIKQDGSEKYYVDSVKG |
| 283 414B06 - CDRH3 (Kabat) | Amino acid sequence of CDRH3 of 414306 using Kabat | VRQWSDYSDY |
| 284 414306 - Heavy chain variable region | Amino acid sequence of $V_H$ of 414B06 | EVHLVESGGGLVQpGGSLRLSCAASGFTFSSYWMNWVRQAPGKGLE WVANIKQDGSEKYYVDSVKGRFTVSRDNAKNSLYLQMNSLRAEDTA VYYCARVRQWSDYSDYWGQGTPVTVSS |
| 285 414306 - Heavy chain variable region | Nucleic acid sequence of $V_H$ of 414B06 | GAGGTGCACCTGGTGGAGTCTGGGGGAGGCTTGGTCCAGCCTGGGG GGTCCCTGAGACTCTCCTGTGCAGCCTCTGGATTCACCTTTAGTAG CTATTGGATGAACTGGGTCCGCCAGGCTCCAGGGAAGGGGCTGGAG TGGGTGGCCAACATAAAGCAAGATGGAAGTGAGAAATACTATGTGG ACTCTGTGAAGGGCCGCTTCACCGTCTCCAGAGACAACGCCAAGAA CTCACTGTATCTGCAAATGAACAGCCTGAGAGCCGAGGACACGGCT GTGTATTACTGTGCGAGAGTTCGACAATGGTCCGACTACTCTGACT ACTGGGGCCAGGGAACCCCGGTCACCGTCTCCTCAG |
| 286 414B06 - full heavy chain sequence | Amino acid sequence of 414B06 heavy chain | EVHLVESGGGLVQPGGSLRLSCAASGFTFSSYWMNWVRQAPGKGLE WVANIKQDGSEKYYVDSVKGRFTVSRDNAKNSLYLQMNSLRAEDTA VYYCARVRQWSDYSDYWGQGTPVTVSSASTKGPSVFPLAPSSKSTS GGTAALGCLVKDYFPEPVTVSWNSGALTSGVHTFPAVLQSSGLYSL SSVVTVPSSSLGTQTYICNVNHKPSNTKVDKKVEPKSCDKTHTCPP CPAPELLGGPSVFLFPPKPKDTLMISRTPEVTCVVVDVSHEDPEVK FNWYVDGVEVHNAKTKPREEQYNSTYRVVSVLTVLHQDWLNGKEYK CKVSNKALPAPIEKTISKAKGQPREPQVYTLPPSRDELTKNQVSLT CLVKGFYPSDIAVEWESNGQPENNYKTTPPVLDSDGSFFLYSKLTV DKSRWQQGNVFSCSVMHEALHNHYTQKSLSLSPGK |
| 287 414B06 - full heavy chain sequence | Nucleic acid sequence of 414B06 heavy chain | GAGGTGCACCTGGTGGAGTCTGGGGGAGGCTTGGTCCAGCCTGGGG GGTCCCTGAGACTCTCCTGTGCAGCCTCTGGATTCACCTTTAGTAG CTATTGGATGAACTGGGTCCGCCAGGCTCCAGGGAAGGGGCTGGAG TGGGTGGCCAACATAAAGCAAGATGGAAGTGAGAAATACTATGTGG ACTCTGTGAAGGGCCGCTTCACCGTCTCCAGAGACAACGCCAAGAA CTCACTGTATCTGCAAATGAACAGCCTGAGAGCCGAGGACACGGCT GTGTATTACTGTGCGAGAGTTCGACAATGGTCCGACTACTCTGACT ACTGGGGCCAGGGAACCCCGGTCACCGTCTCCTCAGCCAGCACCAA GGGCCCCTCTGTGTTCCCTCTGGCCCCTTCCAGCAAGTCCACCTCT GGCGGAACAGCCGCTCTGGGCTGCCTCGTCAAGGACTACTTCCCCG AGCCTGTGACCGTGTCCTGGAACTCTGGCGCTCTGACCAGCGGAGT GCACACCTTCCCTGCTGTGCTCCAGTCCTCCGGCCTGTACTCCCTG TCCTCCGTCGTGACCGTGCCTTCCAGCTCTCTGGGCACCCAGACCT ACATCTGCAACGTGAACCACAAGCCCTCCAACACCAAGGTGGACAA GAAGGTGGAACCCAAGTCCTGCGACAAGACCCACACCTGTCCCCCT TGTCCTGCCCCTGAACTGCTGGGCGGACCTTCCGTGTTCCTGTTCC CCCCAAAGCCCAAGGACACCCTGATGATCTCCCGGACCCCCGAAGT |

TABLE S1-continued

SEQ ID NOS: 1-342

| SEQ ID NO:Name | Description | Sequence |
|---|---|---|
| | | GACCTGCGTGGTGGTGGATGTGTCCCACGAGGACCCTGAAGTGAAG<br>TTCAATTGGTACGTGGACGGCGTGGAAGTGCACAACGCCAAGACCA<br>AGCCTAGAGAGGAACAGTACAACTCCACCTACCGGGTGGTGTCCGT<br>GCTGACCGTGCTGCACCAGGATTGGCTGAACGGCAAAGAGTACAAG<br>TGCAAGGTGTCCAACAAGGCCCTGCCTGCCCCCATCGAAAAGACCA<br>TCTCCAAGGCCAAGGGCCAGCCCCGGGAACCCCAGGTGTACACACT<br>GCCCCCTAGCAGGGACGAGCTGACCAAGAACCAGGTGTCCCTGACC<br>TGTCTCGTGAAAGGCTTCTACCCCTCCGATATCGCCGTGGAATGGG<br>AGTCCAACGGCCAGCCTGAGAACAACTACAAGACCACCCCCCCTGT<br>GCTGGACTCCGACGGCTCATTCTTCCTGTACAGCAAGCTGACAGTG<br>GACAAGTCCCGGTGGCAGCAGGGCAACGTGTTCTCCTGCTCCGTGA<br>TGCACGAGGCCCTGCACAACCACTACACCCAGAAGTCCCTGTCCCT<br>GAGCCCCGGCAAG |
| 288 414B06 - CDRL1 (IMGT) | Amino acid sequence of CDRL1 of 414B06 using IMGT | QGISSW |
| 289 414B06 - CDRL2 (IMGT) | Amino acid sequence of CDRL2 of 414B06 using IMGT | AAS |
| 290 414B06 - CDRL3 (IMGT) | Amino acid sequence of CDRL3 of 414B06 using IMGT | QQANSFPFT |
| 291 414B06 - CDRL1 (Kabat) | Amino acid sequence of CDRL1 of 414B06 using Kabat | RASQGISSWLA |
| 292 414B06 - CDRL2 (Kabat) | Amino acid sequence of CDRL2 of 414B06 using Kabat | AASSLQS |
| 293 414B06 - CDRL3 (Kabat) | Amino acid sequence of CDRL3 of 414B06 using Kabat | QQANSFPFT |
| 294 414B06 - Light chain variable region | Amino acid sequence of $V_L$ of 414B06 | DIQMTQSPSSVSASVGDRVTITCRASQGISSWLAWYQQKPGKAPKL<br>LIYAASSLQSGVPSRFSGSGSGTDFTLTISSLQPEDFATYYCQQAN<br>SFPFTFGPGTKVDIK |
| 295 414B06 - Light chain variable region | Nucleic acid sequence of $V_L$ of 414B06 | GACATCCAGATGACCCAGTCTCCATCTTCCGTGTCTGCATCTGTAG<br>GAGACAGAGTCACCATCACTTGTCGGGCGAGTCAGGGTATTAGCAG<br>CTGGTTAGCCTGGTATCAGCAGAAACCAGGGAAAGCCCCTAAGCTC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTACTATTGTCAACAGGCTAAC<br>AGTTTCCCATTCACTTTCGGCCCTGGGACCAAAGTGGATATCAAAC |
| 296 414B06 - full light chain sequence | Amino acid sequence of 414B06 light chain | DIQMTQSPSSVSASVGDRVTITCRASQGISSWLAWYQQKPGKAPKL<br>LIYAASSLQSGVPSRFSGSGSGTDFTLTISSLQPEDFATYYCQQAN<br>SFPFTFGPGTKVDIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 297 414B06 - full light chain sequence | Nucleic acid sequence of 414B06 light chain | GACATCCAGATGACCCAGTCTCCATCTTCCGTGTCTGCATCTGTAG<br>GAGACAGAGTCACCATCACTTGTCGGGCGAGTCAGGGTATTAGCAG<br>CTGGTTAGCCTGGTATCAGCAGAAACCAGGGAAAGCCCCTAAGCTC<br>CTGATCTATGCTGCATCCAGTTTGCAAAGTGGGGTCCCATCAAGGT<br>TCAGCGGCAGTGGATCTGGGACAGATTTCACTCTCACCATCAGCAG<br>CCTGCAGCCTGAAGATTTTGCAACTTACTATTGTCAACAGGCTAAC<br>AGTTTCCCATTCACTTTCGGCCCTGGGACCAAAGTGGATATCAAAC<br>GTACGGTGGCCGCTCCCTCCGTGTTCATCTTCCCACCTTCCGACGA<br>GCAGCTGAAGTCCGGCACCGCTTCTGTCGTGTGCCTGCTGAACAAC<br>TTCTACCCCCGCGAGGCCAAGGTGCAGTGGAAGGTGGACAACGCCC |

TABLE S1-continued

SEQ ID NOS: 1-342

| SEQ ID NO: Name | Description | Sequence |
|---|---|---|
| | | TGCAGTCCGGCAACTCCCAGGAATCCGTGACCGAGCAGGACTCCAA<br>GGACAGCACCTACTCCCTGTCCTCCACCCTGACCCTGTCCAAGGCC<br>GACTACGAGAAGCACAAGGTGTACGCCTGCGAAGTGACCCACCAGG<br>GCCTGTCTAGCCCCGTGACCAAGTCTTTCAACCGGGGCGAGTGT |
| 298 Mutated 1D05 - LC mutant 3 | Amino acid sequence of 1D05 kappa light chain with V to Y mutation in CDRL2 highlighted | DIQMTQSPSSLSASVGDRVTITCRASQSISSYLNWYQQKPGKAPKL<br>LIYYASSLQSGVPSRFSGSGSGTDFTLTISSLQPEDFATYYCQQSY<br>STPITFGQGTRLEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC |
| 299 1D05 - heavy chain disabled IgG1 Fc | Amino acid sequence of IgG1 disabled variant of 1D05 | EVQLVESGGGLVQPGRSLRLSCAASGFTFDDYAMHWVRQVPGKGLE<br>WVSGISWIRTGIGYADSVKGRFTIFRDNAKNSLYLQMNSLRAEDTA<br>LYYCAKDMKGSGTYGGWFDTWGQGTLVTVSSASTKGPSVFPLAPSS<br>KSTSGGTAALGCLVKDYFPEPVTVSWNSGALTSGVHTFPAVLQSSG<br>LYSLSSVVTVPSSSLGTQTYICNVNHKPSNTKVDKKVEPKSCDKTH<br>TCPPCPAPELAGAPSVFLFPPKPKDTLMISRTPEVTCVVVDVSHED<br>PEVKFNWYVDGVEVHNAKTKPREEQYNSTYRVVSVLTVLHQDWLNG<br>KEYKCKVSNKALPAPIEKTISKAKGQPREPQVYTLPPSRDELTKNQ<br>VSLTCLVKGFYPSDIAVEWESNGQPENNYKTTPPVLDSDGSFFLYS<br>KLTVDKSRWQQGNVFSCSVMHEALHNHYTQKSLSLSPGK |
| 300 1D05 - light chain IL-2 fusion | 1D05 Light chain sequence fused to wild-type human IL-2 sequence (IL-2 amino acid sequence is underlined and region to be varied is shown in bold) | DIQMTQSPSSLSASVGDRVTITCRASQSISSYLNWYQQKPGKAPKL<br>LIYVASSLQSGVPSRFSGSGSGTDFTLTISSLQPEDFATYYCQQSY<br>STPITFGQGTRLEIKRTVAAPSVFIFPPSDEQLKSGTASVVCLLNN<br>FYPREAKVQWKVDNALQSGNSQESVTEQDSKDSTYSLSSTLTLSKA<br>DYEKHKVYACEVTHQGLSSPVTKSFNRGEC<u>APTSSSTKKTQLQLEH</u><br><u>LLLDLQMILNGINNYKNPKLTRMLTFKFYMPKKATELKHLQCLEEE</u><br><u>LKPLEEVLNLAQSKNEHLRPRDLISNINVIVLELKGSETTFMCEYA</u><br><u>DETATIVEFLNRWITFCQSIISTLT</u> |
| 301 Human IL-2 | Uniprot number: P60568 Full length amino acid sequence of human IL-2 (minus signal sequence) | APTESSTEKTQLQLEHLLLDLQMILNGINNYKNPKLTRMLTFKFYM<br>PKKATELKHLQCLEEELKPLEEVLNLAQSKNFHLRPRDLISNINVI<br>VLELKGSETTFMCEYADETATIVEFLNRWITFCQSIISTLT |
| 302 Control 1D05 immunocytokine HC C-terminal fusion | Heavy chain 1D05 IgG1 variant fused at the N-terminus to wild-type human IL2 sequence (control) | EVQLVESGGGLVQPGRSLRLSCAASGFTFDDYAMHWVRQVPGKGLE<br>WVSGISWIRTGIGYADSVKGRFTIFRDNAKNSLYLQMNSLRAEDTA<br>LYYCAKDMKGSGTYGGWFDTWGQGTLVTVSSASTKGPSVFPLAPSS<br>KSTSGGTAALGCLVKDYFPEPVTVSWNSGALTSGVHTFPAVLQSSG<br>LYSLSSVVTVPSSSLGTQTYICNVNHKPSNTKVDKKVEPKSCDKTH<br>TCPPCPAPELAGAPSVFLFPPKPKDTLMISRIPEVICVVVDVSHED<br>PEVKFNWYVDGVEVHNAKTKPREEQYNSTYRVVSVLTVLHQDWLNG<br>KEYKCKVSNKALPAPIEKTISKAKGQPREPQVYTLPPSRDELTKNQ<br>VSLTCLVKGFYPSDIAVEWESNGQPENNYKTTPPVLDSDGSFFLYS<br>KLTVDKSRWQQGNVFSCSVMHEALHNHYTQKSLSLSPGKAPTSSST<br>KKTQLQLEHLLLDLQMILNGINNYKNPKLIRMLTFKFYMPKKATEL<br>KHLQCLEEELKPLEEVLNLAQSKNFHLRPRDLISNINVIVLELKGS<br>ETTFMCEYADETATIVEFLNRWITFCQSIISTLT |
| 303 IL-2 D5-9 | IL-2 IC45 (Del 5-9) N terminal IL-2 sequence | APTSTQLQLELLLD |
| 304 IL-2 D1-9 | IL-2 IC46 (Del 1-9) N terminal IL-2 sequence | TQLQLEHLLLD |
| 305 IL-2 D5-7 | IL-2 IC64 (Del 5-7) N terminal IL-2 sequence | APTSKKTQLQLEHLLLD |
| 306 IL-2 D1 | IL-2 D1 N terminal IL-2 sequence | PTSSSTKKTQLQLEHLLLD |

TABLE S1-continued

SEQ ID NOS: 1-342

| SEQ ID NO:Name | Description | Sequence |
|---|---|---|
| 307 IL-2 D1-2 | IL-2 D1-2 N terminal IL-2 sequence | TSSSTKKTQLQLEHLLLD |
| 308 IL-2 D1-3 | IL-2 D1-3 N terminal IL-2 sequence | SSSTKKTQLQLEHLLLD |
| 309 IL-2 D1-4 | IL-2 D1-4 N terminal IL-2 sequence | SSTKKTQLQLEHLLLD |
| 310 IL-2 D1-5 | IL-2 D1-5 N terminal IL-2 sequence | STKKTQLQLEHLLLD |
| 311 IL-2 D1-6 | IL-2 D1-6 N terminal IL-2 sequence | TKKTQLQLEHLLLD |
| 312 IL-2 D1-7 | IL-2 D1-7 N terminal IL-2 sequence | KKTQLQLEHLLLD |
| 313 IL-2 D1-8 | IL-2 D1-8 N terminal IL-2 sequence | KTQLQLEHLLLD |
| 314 IL-2 D9 | IL-2 D9 N terminal IL-2 sequence | APTSSSTKTQLQLEHLLLD |
| 315 IL-2 D9-8 | IL-2 D9-8 N terminal IL-2 sequence | APTSSSTTQLQLEHLLLD |
| 316 IL-2 D9-7 | IL-2 D9-7 N terminal IL-2 sequence | APTSSSTQLQLEHLLLD |
| 317 IL-2 D9-6 | IL-2 D9-6 N terminal IL-2 sequence | APTSSTQLQLEHLLLD |
| 318 IL-2 D9-4 | IL-2 D9-4 N terminal IL-2 sequence | APTTQLQLEHLLLD |
| 319 IL-2 D9-3 | IL-2 D9-3 N terminal IL-2 sequence | APTQLQLEHLLLD |
| 320 IL-2 D9-2 | IL-2 D9-2 N terminal IL-2 sequence | ATQLQLEHLLLD |
| 321 IL-2 D2-6 | IL-2 D2-6 N terminal IL-2 sequence | ATKKTQLQLEHLLLD |
| 322 IL-2 D3-7 | IL-2 D3-7 N terminal IL-2 sequence | APKKTQLQLEHLLLD |
| 323 IL-2 D4-8 | IL-2 D4-8 N terminal IL-2 sequence | APTKTQLQLEHLLLD |
| 324 C-terminal amino acid sequence of hIL-2 | Amino acids 21 to 133 of hIL-2 | LQMILNGINNYKNPKLTRMLTFKFYMPKKATELKHLQCLEEELKPL EEVLNLAQSKNFHLRPRDLISNINVIVLELKGSETTFMCEYADETA TIVEFLNRWITFCQSIISTLT |

TABLE S1-continued

SEQ ID NOS: 1-342

| SEQ ID NO:Name | Description | Sequence |
|---|---|---|
| 325 Mouse PD-L1 | Uniprot number: Q9EP73 (ECD highlighted in BOLD, and cytoplasmic domain underlined) | MRIFAGIIFTACCHLLRAFTITAPKDLYVVEYGSNVTMECRETVER ELDLLALVVYWEREDEQVIQFVAGEEDLKPQHSNERGRASLPKDQL LKONAALQITDVELQDAGVYCCIISYGGADYKRITLKVNAPYRKIN QRISVDPATSEHELICQAEGYPEAEVINTESDHQPSSGKESVTTSR TEGMLLNVTSSLRVNATANDVFYCTFWRSQPGQNHTAELIIPELPA THPPQNRTHWVLLGSILLFLIVVSTVLLFLRKQVRMLDVEKCGVED TSSKNRNDTQFEET |
| 326 Mouse PD-L1 ECD His | Mouse PD-L1 extracellular domain with his tag | FTITAPKDLYVVEYGSNVTMECRFPVERELDLLALVVYWEKEDEQV IQFVAGEEDLKPQHSNERGRASLPKDQLLKGNAALQITDVKLQDAG VYCCIISYGGADYKRITLKVNAPYRKINQRISVDPATSEHELICQA EGYPEAEVIWTNSDHQPVSGKRSVTTSRTEGMLLNVTSSLRVNATA NDVFYCTFWRSQPGQNHTAELIIPELPATHPPQNRTHHHHHH |
| 327 Human IL-2Rα chain | Human IL-2 receptor alpha chain | ELCDDDPPEIPHATFKAMAYKEGTMLNCECKRGFRRIKSGSLYMLC TGNSSHSSWDNQCQCTSSATRNTTKQVTPQPEEQKERKTTEMQSPM QPVDQASLPGHCREPPPWENEATERIYHFVVGQMVYYQCVQGYRAL HRGPAESVCKMTHGKTRWTQPQLICTGEMETSQFPGEEKPQASPEG RPESETSCLVTTTDFQIQTEMAATMETSIFTTEYQVAVAGCVFLLI SVLLLSGLTWQRRQRKSRRTI |
| 328 Human IL-2Rβ chain | Human IL-2 receptor beta chain | AVNGTSQFTCFYNSRANISCVWSQDGALQDTSCQVHAWPDRRRWNQ TCELLPVSQASWACNLILGAPDSQKLTTVDIVTLRVLCREGVRWRV MAIQDFKPFENLRLMAPISLQVVHVETHRCNISWEISQASHYFERH LEFEARTLSPGHTWEEAPLLTKQKQEWICLETLTPDTQYEFQVRV KPLQGEFTTWSPWSQPLAFRTKPAALGKDTIPWLGHLLVGLSGAFG FIILVYLLINCRNTGPWLKKVLKCNTPDPSKFFSQLSSEHGGDVQK WLSSPFPSSSFSPGGLAPEISPLEVLERDKVTQLLLQQDKVPEPAS LSSNHSLTSCFTNQGYFFFHLPDALEIEACQVYFTYDPYSEEDPDE GVAGAPTGSSPQPLQPLSGEDDAYCTFPSRDDLLLFSPSLLGGPSP PSTAPGGSGAGEERMPPSLQERVPRDWDPQPLGPPTPGVPDLVDFQ PPPELVLREAGEEVPDAGPREGVSFPWSRPPGQGEFRALNARLPLN TDAYLSLQELQGQDPTHLV |
| 329 Human IL-2Rγ chain | Human IL-2 receptor common gamma chain | LNTTILTPNGNEDTTADFFLTTMPTDSLSVSTLPLPEVQCFVFNVE YMNCTWNSSSEPQPTNLTLHYWYKNSDNDKVQKCSHYLFSEEITSG CQLQKKEIHLYQTFVVQLQDPREPRRQATQMLKLQNLVIPWAPENL TLHKLSESQLELNWNNRFLNHCLEHLVQYRTDWDHSWTEQSVDYRH KFSLPSVDGQKRYTFRVRSRFNPLCGSAQHWSEWSHPIHWGSNTSK ENPFLFALEAVVISVGSMGLIISLLCVYFWLERTMPRIPTLKNLED LVTEYHGNFSAWSGVSKGLAESLQPDYSERLCLVSEIPPKGGALGE GPGASPCNQHSPYWAPPCYTLKPET |
| 330 IL-7 | Human IL-7 amino acid sequence | DCDIEGKDGKQYESVLMVSIDQLLDSMKEIGSNCLNNEFNFFKRHI CDANKEGMFLFRAARKLRQFLKMNSTGDFDLHLLKVSEGTTILLNC TGQVKGRKPAALGEAQPTKSLEENKSLKEQKKLNDLCFLKRLLQEI KTCWNKILMGTKEH |
| 331 IL-15 | Human IL-15 amino acid sequence | GIHVFILGCFSAGLPKTEANWVNVISDLKKIEDLIQSMHIDATLYT ESDVHPSCKVTAMKCFLLELQVISLESGDASIHDTVENLIILANNS LSSNGNVTESGCKECEELEEKNIKEFLQSFVHIVQMFINTS |
| 332 IL-21 | Human IL-21 amino acid sequence | QGQDRHMIRMRQLIDIVDQLKNYVNDLVPEFLPAPEDVETNCEWSA FSCFQKAQLKSANTGNNERIINVSIKKLKRKPPSTNAGRRQKHRLT CPSCDSYEKKPPKEFLERFKSLLQKMIHQHLSSRTHGSEDS |
| 333 GM-CSF | Human GM-CSF amino acid sequence | APARSPSPSTQPWEHVNAIQEARRLLNLSRDTAAEMNETVEVISEM FDLQEPTCLQTRLELYKQGLRGSLTKLKGPLTMMASHYKQHCPPTP ETSCATQIITFESFKENLKDFLLVIPFDCWEPVQE |
| 334 IFNα | Human IFN-α amino acid sequence | CDLPQNHGLLSRNTLVLLHQMRRISPFLCLKDRRDFRFPQEMVKGS QLQKAHVMSVLHEMLQQIFSLFHTERSSAAWNMTLLDQLHTELHQQ LQHLETCLLQVVGEGESAGAISSPALTLRRYFQGIRVYLKEKKYSD CAWEVVRMEIMKSLFLSTNMQERLRSKDRDLGS |
| 335 TNFα | Extracellular portion of human TNF-α amino acid sequence | GPQREEFPRDLSLISPLAQAVRSSSRTPSDKPVAHVVANPQAEGQL QWLNRRANALLANGVELRDNQLVVPSEGLYLIYSQVLFKGQGCPST HVLLTHTISRIAVSYQTKVNLLSAIKSPCQRETPEGAEAKPWYEPI YLGGVFQLEKGDRLSAEINRPDYLDFAESGQVYFGIIAL |
| 336 IL-12α | Alpha chain of human IL-12 amino acid sequence | RNLPVATPDPGMFPCLHHSQNLLRAVSNMLQKARQTLEFYPCTSEE IDHEDITKDKTSTVEACLPLELTKNESCLNSRETSFITNGSCLASR KTSFMMALCLSSIYEDLKMYQVEFKTMNAKLLMDPKRQIFLDQNML |

TABLE S1-continued

SEQ ID NOS: 1-342

| SEQ ID NO: | Name | Description | Sequence |
|---|---|---|---|
| | | | AVIDELMQALNFNSETVPQKSSLEEPDFYKTKIKLCILLHAFRIRA VTIDRVMSYLNAS |
| 337 | IL-12β | Beta chain of human IL-12 amino acid sequence | IWELKKDVYVVELDWYPDAPGEMVVLTCDTPEEDGITWTLDQSSEV LGSGKTLTIQVKEFGDAGQYTCHKGGEVLSHSLLLLHKKEDGIWST DILKDQKEPKNKTFLRCEAKNYSGRFTCWWLTTISTDLTFSVKSSR GSSDPQGVTCGAATLSAERVRGDNKEYEYSVECQEDSACPAAEESL PIEVMVDAVHKLKYENYTSSFFIRDIIKPDPPKNLQLKPLKNSRQV EVSWEYPDTWSTPHSYFSLTFCVQVQGKSKREKKDRVFTDKTSATV ICRKNASISVRAQDRYYSSSWSEWASVPCS |
| 338 | CXCL9 | Human CXCL-9 amino acid sequence | TPVVRKGRCSCISTNQGTIHLQSLKDLKQFAPSPSCEKIEIIATLK NGVQTCLNPDSADVKELIKKWEKQVSQKKKQKNGKKHQKKKVLKVR KSQRSRQKKTT |
| 339 | CXCL10 | Human CXCL-10 amino acid sequence | VPLSRTVRCTCISISNQPVNPRSLEKLEIIPASQFCPRVEIIATMK KKGEKRCLNPESKAIKNLLKAVSKERSKRSP |
| 340 | Human WT IgG1 constant region | IGHG1*01 & IGHG1*02 & IGHG1*05 (IgG1) WT human IgG1 amino acid sequence | ASTKGPSVFPLAPSSKSTSGGTAALGCLVKDYFPEPVTVSWNSGAL TSGVHTFPAVLQSSGLYSLSSVVTVPSSSLGTQTYICNVNHKPSNT KVDKKVEPKSCDKTHTCPPCPAPELLGGPSVFLFPPKPKDTLMISR TPEVTCVVVDVSHEDPEVKFNWYVDGVEVHNAKTKPREEQYNSTYR VVSVLTVLHQDWLNGKEYKCKVSNKALPAPIEKTISKAKGQPREPQ VYTLPPSRDELTKNQVSLTCLVKGFYPSDIAVEWESNGQPENNYKT TPPVLDSDGSFFLYSKLTVDKSRWQQGNVFSCSVMHEALHNHYTQK SLSLSPGK |
| 341 | | WT human IgG1 nucleic acid sequence | GCCAGCACCAAGGGCCCCTCTGTGTTCCCTCTGGCCCCTTCCAGCA AGTCCACCTCTGGCGGAACAGCCGCTCTGGGCTGCCTCGTGAAGGA CTACTTCCCCGAGCCTGTGACCGTGTCCTGGAACTCTGGCGCTCTG ACCAGCGGAGTGCACACCTTCCCTGCTGTGCTGCAGTCCTCCGGCC TGTACTCCCTGTCCTCCGTCGTGACCGTGCCTTCCAGCTCTCTGGG CACCCAGACCTACATCTGCAACGTGAACCACAAGCCCTCCAACACC AAGGTGGACAAGAAGGTGGAACCCAAGTCCTGCGACAAGACCCACA CCTGTCCCCCTTGTCCTGCCCCTGAACTGCTGGGCGGACCTTCCGT GTTCCTGTTCCCCCCAAAGCCCAAGGACACCCTGATGATCTCCCGG ACCCCCGAAGTGACCTGCGTGGTGGTGGATGTGTCCCACGAGGACC CTGAAGTGAAGTTCAATTGGTACGTGGACGGCGTGGAAGTGCACAA CGCCAAGACCAAGCCTAGAGAGGAACAGTACAACTCCACCTACCGG GTGGTGTCCGTGCTGACCGTGCTGCACCAGGATTGGCTGAACGGCA AAGAGTACAAGTGTCCAACAAGGCCCTGCCTGCCCCCAT CGAAAAGACCATCTCCAAGGCCAAGGGCCAGCCCCGGGAACCCCAG GTGTACACACTGCCCCCTAGCAGGGACGAGCTGACCAAGAACCAGG TGTCCCTGACCTGTCTCGTGAAAGGCTTCTACCCCTCCGATATCGC CGTGGAATGGGAGTCCAACGGCCAGCCTGAGAACAACTACAAGACC ACCCCCCCTGTGCTGGACTCCGACGGCTCATTCTTCCTGTACAGCA AGCTGACAGTGGACAAGTCCCGGTGGCAGCAGGGCAACGTGTTCTC CTGCTCCGTGATGCACGAGGCCCTGCACAACCACTACACCCAGAAG TCCCTGTCCCTGAGCCCCGGCAAGTGATGA |
| 342 | Mutated 1D05 - HC mutant 2 | Amino acid sequence of 1D05 heavy chain with V to A and F to S back-mutation in framework region to germline highlighted with IgG1 disabled (LAGA) constant region | EVQLVESGGGLVQPGRSLRLSCAASGFTFDDYAMHWVRQ<u>A</u>PGKGLE WVSGISWIRTGIGYADSVKGRFTI<u>S</u>RDNAKNSLYLQMNSLRAEDTA LYYCAKDMKGSGTYGGWFDTWGQGTLVTVSSASTKGPSVFPLAPCS RSTSESTAALGCLVKDYFPEPVTVSWNSGALTSGVHTFPAVLQSSG LYSLSSVVTVPSSSLGTKTYTCNVDHKPSNTKVDKRVESKYGPPCP PCPAPELAGAPSVFLFPPKPKDTLMISRTPEVTCVVVDVSQEDPEV QFNWYVDGVEVHNAKTKPREEQFNSTYRVVSVLTVLHQDWLNGKEY KCKVSNKGLPSSIEKTISKAKGQPREPQVYTLPPSQEEMTKNQVSL TCLVKGFYPSDIAVEWESNGQPENNYKTTPPVLDSDGSFFLYSRLT VDKSRWQEGNVFSCSVMHEALHNHYTQKSLSLSLGK |

TABLE S2

SEQ ID NOS: 343-538

| SEQ ID NO: | Name | Description | Sequence |
|---|---|---|---|
| 343 | 416E01 - CDRH1 (IMGT) | Amino acid sequence of CDRH1 of 416E01 using IMGT | GFTFSNYA |
| 344 | 416E01 - CDRH2 (IMGT) | Amino acid sequence of CDRH2 of 416E01 using IMGT | ISFSGGTT |
| 345 | 416E01 - CDRH3 (IMGT) | Amino acid sequence of CDRH3 of 416E01 using IMGT | AKDEAPAGATFFDS |
| 346 | 416E01 - CDRH1 (Kabat) | Amino acid sequence of CDRH1 of 416E01 using Kabat | NYAMS |
| 347 | 416E01 - CDRH2 (Kabat) | Amino acid sequence of CDRH2 of 416E01 using Kabat | AISFSGGTTYYADSVKG |
| 348 | 416E01 - CDRH3 (Kabat) | Amino acid sequence of CDRH3 of 416E01 using Kabat | DEAPAGATFFDS |
| 349 | 416E01 - Heavy chain variable region | Amino acid sequence of V$_H$ of 416E01 (mutations from germline are shown in bold letters) | EVQLAESGGGLVQPGGSLRLSCAASGFTFSNYAMSWVRQTPGKGL EWVSAISFSGGTTYYADSVKGRFTISRDNSKNTLYLHMNSLRADD TAVYYCAKDEAPAGATFFDSWGQGTLVTVSS |
| 350 | 416E01 - Heavy chain variable region | Nucleic acid sequence of V$_H$ of 416E01 | GAAGTGCAACTGGCGGAGTCTGGGGGAGGCTTGGTACAGCCGGGG GGGTCCCTGAGACTCTCCTGTGCAGCCTCTGGATTCACCTTTAGC AACTATGCCATGAGTTGGGTCCGCCAGACTCCAGGAAAGGGGCTG GAGTGGGTCTCAGCTATTAGTTTTAGTGGTGGTACTACATACTAC GCTGACTCCGTGAAGGGCCGGTTCACCATCTCCAGAGACAATTCC AAGAACACGCTGTATTTGCACATGAACAGCCTGAGAGCCGATGAC ACGGCCGTATATTACTGTGCGAAAGATGAGGCACCAGCTGGCGCA ACCTTCTTTGACTCCTGGGGCCAGGGAACGCTGGTCACCGTCTCC TCAG |
| 351 | 416E01 - full heavy chain sequence | Amino acid sequence of 416E01 heavy chain | EVQLAESGGGLVQPGGSLRLSCAASGFTFSNYAMSWVRQTPGKGL EWVSAISFSGGTTYYADSVKGRFTISRDNSKNTLYLHMNSLRADD TAVYYCAKDEAPAGATFFDSWGQGTLVTVSSASTKGPSVFPLAPC SRSTSESTAALGCLVKDYFPEPVTVSWNSGALTSGVHTFPAVLQS SGLYSLSSVVTVPSSSLGTKTYTCNVDHKPSNTKVDKRVESKYGP PCPPCPAPEFEGGPSVFLFPPKPKDTLMISRTPEVTCVVVDVSQE DPEVQFNWYVDGVEVHNAKTKPREEQFNSTYRVVSVLTVLHQDWL NGKEYKCKVSNKGLPSSIEKTISKAKGQPREPQVYTLPPSQEEMT KNQVSLTCLVKGFYPSDIAVEWESNGQPENNYKTTPPVLDSDGSF FLYSRLTVDKSRWQEGNVFSCSVMHEALHNHYTQKSLSLSLGK |
| 352 | 416E01 - full heavy chain sequence | Nucleic acid sequence of 416E01 heavy chain | GAAGTGCAACTGGCGGAGTCTGGGGGAGGCTTGGTACAGCCGGGG GGGTCCCTGAGACTCTCCTGTGCAGCCTCTGGATTCACCTTTAGC AACTATGCCATGAGTTGGGTCCGCCAGACTCCAGGAAAGGGGCTG GAGTGGGTCTCAGCTATTAGTTTTAGTGGTGGTACTACATACTAC GCTGACTCCGTGAAGGGCCGGTTCACCATCTCCAGAGACAATTCC AAGAACACGCTGTATTTGCACATGAACAGCCTGAGAGCCGATGAC ACGGCCGTATATTACTGTGCGAAAGATGAGGCACCAGCTGGCGCA ACCTTCTTTGACTCCTGGGGCCAGGGAACGCTGGTCACCGTCTCC TCAGCCAGCACCAAGGGCCCTTCCGTGTTCCCCCTGGCCCCTTGC AGCAGGAGCACCTCCGAATCCACAGCTGCCCTGGGCTGTCTGGTG AAGGACTACTTTCCCGAGCCCGTGACCGTGAGCTGGAACAGCGGC GCTCTGACATCCGGCGTCCACACCTTTCCTGCCGTCCTGCAGTCC TCCGGCCTCTACTCCCTGTCCTCCGTGGTGACCGTGCCTAGCTCC TCCCTCGGCACCAAGACCTACACCTGTAACGTGGACCACAAACCC TCCAACACCAAGGTGGACAAACGGGTCGAGAGCAAGTACGGCCCT CCCTGCCCTCCTTGTCCTGCCCCCGAGTTCGAAGGCGGACCCAGC GTGTTCCTGTTCCCTCCTAAGCCCAAGGACACCCTCATGATCAGC CGGACACCCGAGGTGACCTGCGTGGTGGTGGATGTGAGCCAGGAA GACCCTGAGGTCCAGTTCAACTGGTATGTGGATGGCGTGGAGGTG CACAACGCCAAGACAAAGCCCCGGGAAGAGCAGTTCAACTCCACC TACAGGGTGGTCAGCGTGCTGACCGTGCTGCATCAGGACTGGCTG AACGGCAAGGAGTACAAGTGCAAGGTCAGCAATAAGGGACTGCCC AGCAGCATCGAGAAGACCATCTCCAAGGCTAAAGGCCAGCCCCGG |

TABLE S2-continued

SEQ ID NOS: 343-538

| SEQ ID NO: | Name | Description | Sequence |
|---|---|---|---|
| | | | GAACCTCAGGTGTACACCCTGCCTCCCAGCCAGGAGGAGATGACC AAGAACCAGGTGAGCCTGACCTGCCTGGTGAAGGGATTCTACCCT TCCGACATCGCCGTGGAGTGGGAGTCCAACGGCCAGCCCGAGAAC AATTATAAGACCACCCCTCCCGTCCTCGACAGCGACGGATCCTTC TTTCTGTACTCCAGGCTGACCGTGGATAAGTCCAGGTGGCAGGAA GGCAACGTGTTCAGCTGCTCCGTGATGCACGAGGCCCTGCACAAT CACTACACCCAGAAGTCCCTGAGCCTGTCCCTGGGAAAG |
| 353 | 416E01 - CDRL1 (IMGT) | Amino acid sequence of CDRL1 of 416E01 using IMGT | QGIRRW |
| 354 | 416E01 - CDRL2 (IMGT) | Amino acid sequence of CDRL2 of 416E01 using IMGT | GAS |
| 355 | 416E01 - CDRL3 (IMGT) | Amino acid sequence of CDRL3 of 416E01 using IMGT | QQANSFPIT |
| 356 | 416E01 - CDRL1 (Kabat) | Amino acid sequence of CDRL1 of 416E01 using Kabat | RASQGIRRWLA |
| 357 | 416E01 - CDRL2 (Kabat) | Amino acid sequence of CDRL2 of 416E01 using Kabat | GASSLQS |
| 358 | 416E01 - CDRL3 (Kabat) | Amino acid sequence of CDRL3 of 416E01 using Kabat | QQANSFPIT |
| 359 | 416E01 - Light chain variable region | Amino acid sequence of V$_L$ of 416E01 (mutations from germline are shown in bold letters) | DIQMTQSPSSVSASVGDRVTITCRASQGIRRWLAWYQQKPGKAPK LLISGASSLQSGVPSRFSGSGSGTDFTLIITSLQPEDFATYYCQQ ANSFPITFGQGTRLEIK |
| 360 | 416E01 - Light chain variable region | Nucleic acid sequence of V$_L$ of 416E01 | GACATCCAGATGACCCAGTCTCCATCTTCCGTGTCTGCATCTGTA GGAGACAGAGTCACCATCACTTGTCGGGCGAGTCAGGGTATTAGG AGGTGGTTAGCCTGGTATCAGCAGAAACCAGGGAAAGCCCCTAAA CTCCTGATCTCTGGTGCATCCAGTTTGCAAAGTGGGGTCCCATCA AGGTTCAGCGGCAGTGGATCTGGGACAGATTTCACTCTCATCATT ACCAGTCTGCAGCCTGAAGATTTTGCAACTTACTATTGTCAACAG GCTAACAGTTTCCCGATCACCTTCGGCCAAGGGACACGACTGGAG ATCAAAC |
| 361 | 416E01 - full light chain sequence | Amino acid sequence of 416E01 light chain | DIQMTQSPSSVSASVGDRVTITCRASQGIRRWLAWYQQKPGKAPK LLISGASSLQSGVPSRFSGSGSGTDFTLIITSLQPEDFATYYCQQ ANSFPITFGQGTRLEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 362 | 416E01 - full light chain sequence | Nucleic acid sequence of 416E01 light chain | GACATCCAGATGACCCAGTCTCCATCTTCCGTGTCTGCATCTGTA GGAGACAGAGTCACCATCACTTGTCGGGCGAGTCAGGGTATTAGG AGGTGGTTAGCCTGGTATCAGCAGAAACCAGGGAAAGCCCCTAAA CTCCTGATCTCTGGTGCATCCAGTTTGCAAAGTGGGGTCCCATCA AGGTTCAGCGGCAGTGGATCTGGGACAGATTTCACTCTCATCATT ACCAGTCTGCAGCCTGAAGATTTTGCAACTTACTATTGTCAACAG GCTAACAGTTTCCCGATCACCTTCGGCCAAGGGACACGACTGGAG ATCAAACGTACGGTGGCCGCTCCCTCCGTGTTCATCTTCCCACCT TCCGACGAGCAGCTGAAGTCCGGCACCGCTTCTGTCGTGTGCCTG CTGAACAACTTCTACCCCCGCGAGGCCAAGGTGCAGTGGAAGGTG GACAACGCCCTGCAGTCCGGCAACTCCCAGGAATCCGTGACCGAG CAGGACTCCAAGGACAGCACCTACTCCCTGTCCTCCACCCTGACC CTGTCCAAGGCCGACTACGAGAAGCACAAGGTGTACGCCTGCGAA GTGACCCACCAGGGCCTGTCTAGCCCCGTGACCAAGTCTTTCAAC CGGGGCGAGTGT |
| 363 | STIM001 - CDRH1 | Amino acid sequence of CDRH1 of STIM001 using IMGT | GYTFSTFG |

TABLE S2-continued

SEQ ID NOS: 343-538

| SEQ ID NO: | Name | Description | Sequence |
|---|---|---|---|
| 364 | STIM001 - CDRH2 | Amino acid sequence of CDRH2 of STIM001 using IMGT | ISAYNGDT |
| 365 | STIM001 - CDRH3 | Amino acid sequence of CDRH3 of STIM001 using IMGT | ARSSGHYYYYGMDV |
| 366 | STIM001 - Heavy chain variable region | Amino acid sequence of $V_H$ of STIM001 | QVQVVQSGAEVKKPGASVKVSCKASGYTFSTFGITWVRQAPGQGL EWMGWISAYNGDTNYAQNLQGRVIMTTDTSTSTAYMELRSLRSDD TAVYYCARSSGHYYYYGMDVWGQGTTVTVSS |
| 367 | STIM001 - Heavy chain variable region | Nucleic acid sequence of $V_H$ of STIM001 | CAGGTTCAGGTGGTGCAGTCTGGAGCTGAGGTGAAGAAGCCTGGG GCCTCAGTGAAGGTCTCCTGCAAGGCTTCTGGTTACACCTTTTCC ACCTTTGGTATCACCTGGGTGCGACAGGCCCCTGGACAAGGGCTT GAATGGATGGGATGGATCAGCGCTTACAATGGTGACACAAACTAT GCACAGAATCTCCAGGGCAGAGTCATCATGACCACAGACACATCC ACGAGCACAGCCTACATGGAGCTGAGGAGCCTGAGATCTGACGAC ACGGCCGTTTATTACTGTGCGAGGAGCAGTGGCCACTACTACTAC TACGGTATGGACGTCTGGGGCCAAGGGACCACGGTCACCGTCTCC TCA |
| 368 | STIM001 - full heavy chain sequence | Amino acid sequence of STIM001 heavy chain | QVQVVQSGAEVKKPGASVKVSCKASGYTFSTFGITWVRQAPGQGL EWMGWISAYNGDTNYAQNLQGRVIMTTDTSTSTAYMELRSLRSDD TAVYYCARSSGHYYYYGMDVWGQGTTVTVSSASTKGPSVFPLAPS SKSTSGGTAALGCLVKDYFPEPVTVSWNSGALTSGVHTFPAVLQS SGLYSLSSVVTVPSSSLGTQTYICNVNHKPSNTKVDKKVEPKSCD KTHTCPPCPAPELLGGPSVFLFPPKPKDTLMISRTPEVTCVVVDV SHEDPEVKFNWYVDGVEVHNAKTKPREEQYNSTYRVVSVLTVLHQ DWLNGKEYKCKVSNKALPAPIEKTISKAKGQPREPQVYTLPPSRD ELTKNQVSLTCLVKGFYPSDIAVEWESNGQPENNYKTTPPVLDSD GSFFLYSKLTVDKSRWQQGNVFSCSVMHEALHNHYTQKSLSLSPG K |
| 369 | STIM001 - full heavy chain sequence | Nucleic acid sequence of STIM001 heavy chain | CAGGTTCAGGTGGTGCAGTCTGGAGCTGAGGTGAAGAAGCCTGGG GCCTCAGTGAAGGTCTCCTGCAAGGCTTCTGGTTACACCTTTTCC ACCTTTGGTATCACCTGGGTGCGACAGGCCCCTGGACAAGGGCTT GAATGGATGGGATGGATCAGCGCTTACAATGGTGACACAAACTAT GCACAGAATCTCCAGGGCAGAGTCATCATGACCACAGACACATCC ACGAGCACAGCCTACATGGAGCTGAGGAGCCTGAGATCTGACGAC ACGGCCGTTTATTACTGTGCGAGGAGCAGTGGCCACTACTACTAC TACGGTATGGACGTCTGGGGCCAAGGGACCACGGTCACCGTCTCC TCAGCCAGCACCAAGGGCCCCTCTGTGTTCCCTCTGGCCCCTTCC AGCAAGTCCACCTCTGGCGGAACAGCCGCTCTGGGCTGCCTCGTG AAGGACTACTTCCCCGAGCCTGTGACCGTGTCCTGGAACTCTGGC GCTCTGACCAGCGGAGTGCACACCTTCCCTGCTGTGCTGCAGTCC TCCGGCCTGTACTCCCTGTCCTCCGTCGTGACCGTGCCTTCCAGC TCTCTGGGCACCCAGACCTACATCTGCAACGTGAACCACAAGCCC TCCAACACCAAGGTGGACAAGAAGGTGGAACCCAAGTCCTGCGAC AAGACCCACACCTGTCCCCCTTGTCCTGCCCCTGAACTGCTGGGC GGACCTTCCGTGTTCCTGTTCCCCCCAAAGCCCAAGGACACCCTG ATGATCTCCCGGACCCCCGAAGTGACCTGCGTGGTGGTGGATGTG TCCCACGAGGACCCTGAAGTGAAGTTCAATTGGTACGTGGACGGC GTGGAAGTGCACAACGCCAAGACCAAGCCTAGAGAGGAACAGTAC AACTCCACCTACCGGGTGGTGTCCGTGCTGACCGTGCTGCACCAG GATTGGCTGAACGGCAAAGAGTACAAGTGCAAGGTGTCCAACAAG GCCCTGCCTGCCCCCATCGAAAAGACCATCTCCAAGGCCAAGGGC CAGCCCCGGGAACCCCAGGTGTACACACTGCCCCCTAGCAGGGAC GAGCTGACCAAGAACCAGGTGTCCCTGACCTGTCTCGTGAAAGGC TTCTACCCCTCCGATATCGCCGTGGAATGGGAGTCCAACGGCCAG CCTGAGAACAACTACAAGACCACCCCCCCTGTGCTGGACTCCGAC GGCTCATTCTTCCTGTACAGCAAGCTGACAGTGGACAAGTCCCGG TGGCAGCAGGGCAACGTGTTCTCCTGCTCCGTGATGCACGAGGCC CTGCACAACCACTACACCCAGAAGTCCCTGTCCCTGAGCCCCGGC AAGTGATGA |
| 370 | STIM001 - CDRL1 | Amino acid sequence of CDRL1 of STIM001 using IMGT | QSLLHSNEYNY |

TABLE S2-continued

SEQ ID NOS: 343-538

| SEQ ID NO: | Name | Description | Sequence |
|---|---|---|---|
| 371 | STIM001 - CDRL2 | Amino acid sequence of CDRL2 of STIM001 using IMGT | LGS |
| 372 | STIM001 - CDRL3 | Amino acid sequence of CDRL3 of STIM001 using IMGT | MQSLQTPLT |
| 373 | STIM001 - Light chain variable region | Amino acid sequence of $V_L$ of STIM001 | DIVMTQSPLSLPVTPGEPASISCRSSQSLLHSNEYNYLDWYLQKP GQSPQLLIFLGSNRASGVPDRFSGSGSGTDFTLKITRVEAEDVGI YYCMQSLQTPLTFGGGTKVEIK |
| 374 | STIM001 - Light chain variable region | Nucleic acid sequence of $V_L$ of STIM001 | GATATTGTGATGACTCAGTCTCCACTCTCCCTGCCCGTCACCCCT GGAGAGCCGGCCTCCATCTCCTGCAGGTCTAGTCAGAGCCTCCTG CATAGTAATGAATACAACTATTTGGATTGGTACCTGCAGAAGCCA GGGCAGTCTCCACAGCTCCTGATCTTTTTGGGTTCTAATCGGGCC TCCGGGGTCCCTGACAGGTTCAGTGGCAGTGGATCAGGCACAGAT TTTACACTGAAAATCACCAGAGTGGAGGCTGAGGATGTTGGAATT TATTACTGCATGCAATCTCTACAAACTCCGCTCACTTTCGGCGGA GGGACCAAGGTGGAGATCAAA |
| 375 | STIM001 - full light chain sequence | Amino acid sequence of STIM001 light chain | DIVMTQSPLSLPVTPGEPASISCRSSQSLLHSNEYNYLDWYLQKP GQSPQLLIFLGSNRASGVPDRFSGSGSGTDFTLKITRVEAEDVGI YYCMQSLQTPLTFGGGTKVEIKRTVAAPSVFIFPPSDEQLKSGTA SVVCLLNNFYPREAKVQWKVDNALQSGNSQESVTEQDSKDSTYSL SSTLTLSKADYEKHKVYACEVTHQGLSSPVTKSFNRGEC |
| 376 | STIM001 - full light chain sequence | Nucleic acid sequence of STIM001 light chain | GATATTGTGATGACTCAGTCTCCACTCTCCCTGCCCGTCACCCCT GGAGAGCCGGCCTCCATCTCCTGCAGGTCTAGTCAGAGCCTCCTG CATAGTAATGAATACAACTATTTGGATTGGTACCTGCAGAAGCCA GGGCAGTCTCCACAGCTCCTGATCTTTTTGGGTTCTAATCGGGCC TCCGGGGTCCCTGACAGGTTCAGTGGCAGTGGATCAGGCACAGAT TTTACACTGAAAATCACCAGAGTGGAGGCTGAGGATGTTGGAATT TATTACTGCATGCAATCTCTACAAACTCCGCTCACTTTCGGCGGA GGGACCAAGGTGGAGATCAAAcgtacggtggccgctccctccgtg ttcatcttcccaccttccgacgagcagctgaagtccggcaccgct tctgtcgtgtgcctgctgaacaacttctaccccgcgaggccaag gtgcagtggaaggtggacaacgccctgcagtccggcaactcccag gaatccgtgaccgagcaggactccaaggacagcacctactccctg tcctccaccctgaccctgtccaaggccgactacgagaagcacaag gtgtacgcctgcgaagtgacccaccagggcctgtctagccccgtg accaagtctttcaaccggggcgagtgt |
| 377 | STIM002 - CDRH1 | Amino acid sequence of CDRH1 of STIM002 using IMGT | GYTFTSYG |
| 378 | STIM002 - CDRH2 | Amino acid sequence of CDRH2 of STIM002 using IMGT | ISAYNGNT |
| 379 | STIM002 - CDRH3 | Amino acid sequence of CDRH3 of STIM002 using IMGT | ARSTYFYGSGTLYGMDV |
| 380 | STIM002 - Heavy chain variable region | Amino acid sequence of $V_H$ of STIM002 | QVQLVQSGGEVKKPGASVKVSCKASGYTFTSYGFSWVRQAPGQGL EWMGWISAYNGNTNYAQKLQGRVTMTTDTSTSTAYMELRSLRSDD TAVYYCARSTYFYGSGTLYGMDVWGQGTTVTVSS |
| 381 | STIM002 - Heavy chain variable region | Nucleic acid sequence of $V_H$ of STIM002 | CAGGTTCAACTGGTGCAGTCTGGAGGTGAGGTGAAGAAGCCTGGG GCCTCAGTGAAGGTCTCCTGCAAGGCTTCTGGTTACACCTTTACC AGCTATGGTTTCAGCTGGGTGCGACAGGCCCCTGGACAAGGACTA GAGTGGATGGGATGGATCAGCGCTTACAATGGTAACACAAACTAT GCACAGAAGCTCCAGGGCAGAGTCACCATGACCACAGACACATCC ACGAGCACAGCCTACATGGAGCTGAGGAGCTTGAGATCTGACGAC ACGGCCGTGTATTACTGTGCGAGATCTACGTATTTCTATGGTTCG GGGACCCTCTACGGTATGGACGTCTGGGGCCAAGGGACCACGGTC ACCGTCTCCTCA |

TABLE S2-continued

SEQ ID NOS: 343-538

| SEQ ID NO: | Name | Description | Sequence |
|---|---|---|---|
| 382 | STIM002 - full heavy chain sequence | Amino acid sequence of STIM002 heavy chain | QVQLVQSGGEVKKPGASVKVSCKASGYTFTSYGFSWVRQAPGQGL EWMGWISAYNGNTNYAQKLQGRVTMTTDTSTSTAYMELRSLRSDD TAVYYCARSTYFYGSGTLYGMDVWGQGTTVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 383 | STIM002 - full heavy chain sequence | Nucleic acid sequence of STIM002 heavy chain | CAGGTTCAACTGGTGCAGTCTGGAGGTGAGGTGAAGAAGCCTGGG GCCTCAGTGAAGGTCTCCTGCAAGGCTTCTGGTTACACCTTTACC AGCTATGGTTTCAGCTGGGTGCGACAGGCCCCTGGACAAGGACTA GAGTGGATGGGATGGATCAGCGCTTACAATGGTAACACAAACTAT GCACAGAAGCTCCAGGGCAGAGTCACCATGACCACAGACACATCC ACGAGCACAGCCTACATGGAGCTGAGGAGCTTGAGATCTGACGAC ACGGCCGTGTATTACTGTGCGAGATCTACGTATTTCTATGGTTCG GGGACCCTCTACGGTATGGACGTCTGGGGCCAAGGGACCACGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |
| 384 | STIM002 - CDRL1 | Amino acid sequence of CDRL1 of STIM002 using IMGT | QSLLHSDGYNY |
| 385 | STIM002 - CDRL2 | Amino acid sequence of CDRL2 of STIM002 using IMGT | LGS |
| 386 | STIM002 - CDRL3 | Amino acid sequence of CDRL3 of STIM002 using IMGT | MQALQTPLS |
| 387 | STIM002 - Light chain variable region | Amino acid sequence of $V_L$ of STIM002 | DIVMTQSPLSLPVTPGEPASISCRSSQSLLHSDGYNYLDWYLQKP GQSPOLLIYLGSTRASGFPDRFSGSGSGTDETLKTSRVEAEDVGV YYCMQALQTPLSFGQGTKLEIK |
| 388 | STIM002 - Light chain variable region | Nucleic acid sequence of $V_L$ of STIM002 | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTGTTTGGATTGGTACCTGCAGAAGCCA GGGCAGTCTCCACAGCTCCTGATCTATTTGGGTTCTACTCGGGCC TCCGGGGTTCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGTGCAGTTTTGGCCAG GGGACCAAGCTGGAGATCAAA |
| 389 | STIM002 - full light chain | Amino acid sequence of STIM002 light chain | DIVMTQSPLSLPVTPGEPASISCRSSQSLLHSDGYNYLDWYLQKP GQSPQLLIYLGSTRASGFPDRFSGSGSGTDFTLKISRVEAEDVGV YYCMQALQTPLSFGQGTKLEIKRTVAAPSVFIFPPSDEQLKSGTA |

TABLE S2-continued

SEQ ID NOS: 343-538

| SEQ ID NO: | Name | Description | Sequence |
|---|---|---|---|
| | chain sequence | | SVVCLLNNFYPREAKVQWKVDNALQSGNSQESVTEQDSKDSTYSL SSTLTLSKADYEKHKVYACEVTHQGLSSPVTKSFNRGEC |
| 390 | STIM002 - full light chain sequence | Nucleic acid sequence of STIM002 light chain | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTGTTTGGATTGGTACCTGCAGAAGCCA GGGCAGTCTCCACAGCTCCTGATCTATTTGGGTTCTACTCGGGCC TCCGGGTTCCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGTGCAGTTTTGGCCAG GGGACCAAGCTGGAGATCAAAcgtacggtggccgctccctccgtg ttcatcttcccaccttccgacgagcagctgaagtccggcaccgct tctgtcgtgtgcctgctgaacaacttctacccccgcgaggccaag gtgcagtggaaggtggacaacgcc
ctgcagtccggcaactcccag gaatccgtgaccgagcaggactccaaggacagcacctactccctg tcctccaccctgaccctgtccaaggccgactacgagaagcacaag gtgtacgcctgcgaagtgacccaccagggcctgtctagccccgtg accaagtctttcaaccggggcgagtgt |
| 391 | STIM002-B - CDRH1 IMGT | Amino acid sequence of CDRH1 of STIM002-B using IMGT | GYTFTSYG |
| 392 | STIM002-B - CDRH2 | Amino acid sequence of CDRH2 of STIM002-B using IMGT | ISAYNGNT |
| 393 | STIM002-B - CDRH3 IMGT | Amino acid sequence of CDRH3 of STIM002-B using | ARSTYFYGSGTLYGMDV |
| 394 | STIM002-B - Heavy chain variable region | Amino acid sequence of V$_H$ of STIM002-B | QVQLVQSGGEVKKPGASVKVSCKASGYTFTSYGFSWVRQAPGQGL EWMGWISAYNGNTNYAQKLQGRVTMTTDTSTSTAYMELRSLRSDD TAVYYCARSTYFYGSGTLYGMDVWGQGTTVTVSS |
| 395 | STIM002-B - Heavy chain variable region | Nucleic acid sequence of VH of STIM002-B | CAGGTTCAACTGGTGCAGTCTGGAGGTGAGGTGAAGAAGCCTGGG GCCTCAGTGAAGGTCTCCTGCAAGGCTTCTGGTTACACCTTTACC AGCTATGGTTTCAGCTGGGTGCGACAGGCCCCTGGACAAGGACTA GAGTGGATGGGATGGATCAGCGCTTACAATGGTAACACAAACTAT GCACAGAAGCTCCAGGGCAGAGTCACCATGACCACAGACACATCC ACGAGCACAGCCTACATGGAGCTGAGGAGCTTGAGATCTGACGAC ACGGCCGTGTATTACTGTGCGAGATCTACGTATTTCTATGGTTCG GGGACCCTCTACGGTATGGACGTCTGGGGCCAAGGGACCACGGTC ACCGTCTCCTCA |
| 396 | STIM002-B - full heavy chain sequence | Amino acid sequence of STIM002-B heavy chain | QVQLVQSGGEVKKPGASVKVSCKASGYTFTSYGFSWVRQAPGQGL EWMGWISAYNGNTNYAQKLQGRVTMTTDTSTSTAYMELRSLRSDD TAVYYCARSTYFYGSGTLYGMDVWGQGTTVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 397 | STIM002-B - full heavy chain sequence | Nucleic acid sequence of STIM002-B heavy chain | CAGGTTCAACTGGTGCAGTCTGGAGGTGAGGTGAAGAAGCCTGGG GCCTCAGTGAAGGTCTCCTGCAAGGCTTCTGGTTACACCTTTACC AGCTATGGTTTCAGCTGGGTGCGACAGGCCCCTGGACAAGGACTA GAGTGGATGGGATGGATCAGCGCTTACAATGGTAACACAAACTAT GCACAGAAGCTCCAGGGCAGAGTCACCATGACCACAGACACATCC ACGAGCACAGCCTACATGGAGCTGAGGAGCTTGAGATCTGACGAC ACGGCCGTGTATTACTGTGCGAGATCTACGTATTTCTATGGTTCG GGGACCCTCTACGGTATGGACGTCTGGGGCCAAGGGACCACGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG |

TABLE S2-continued

SEQ ID NOS: 343-538

| SEQ ID NO: | Name | Description | Sequence |
|---|---|---|---|
|  |  |  | AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |
| 398 | STIM002-B - CDRL1 IMGT | Amino acid sequence of CDRL1 of STIM002-B using IMGT | QSLLHSDGYNC |
| 399 | STIM002-B - CDRL2 IMGT | Amino acid sequence of CDRL2 of STIM002-B using IMGT | LGS |
| 400 | STIM002-B - CDRL3 IMGT | Amino acid secuence of CDRL3 of STIM002-B using IMGT | MQALQTPCS |
| 401 | STIM002-B - Light chain variable region | Amino acid sequence of VL of STIM002-B | DIVMTQSPLSLPVTPGEPASISCRSSQSLLHSDGYNCLDWYLQKP GQSPQLLIYLGSTRASGFPDRFSGSGSGTDFTLKISRVEAEDVGV YYCMQALQTPCSFGQGTKLEIK |
| 402 | STIM002-B - Light chain variable region | Nucleic acid sequence of VL of STIM002-B | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTGTTTGGATTGGTACCTGCAGAAGCCA GGGCAGTCTCCACAGCTCCTGATCTATTTGGGTTCTACTCGGGCC TCCGGGTTCCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGTGCAGTTTTGGCCAG GGGACCAAGCTGGAGATCAAA |
| 403 | STIM002-B - full light chain sequence | Amino acid sequence of STIM002-B light chain | DIVMTQSPLSLPVTPGEPASISCRSSQSLLHSDGYNCLDWYLQKP GQSPQLLIYLGSTRASGFPDRFSGSGSGTDFTLKISRVEAEDVGV YYCMQALQTPCSFGQGTKLEIKRTVAAPSVFIFPPSDEQLKSGTA SVVCLLNNFYPREAKVQWKVDNALQSGNSQESVTEQDSKDSTYSL SSTLTLSKADYEKHKVYACEVTHQGLSSPVTKSFNRGEC |
| 404 | STIM002-B - full light chain sequence | Nucleic acid sequence of STIM002-B light chain | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTGTTTGGATTGGTACCTGCAGAAGCCA GGGCAGTCTCCACAGCTCCTGATCTATTTGGGTTCTACTCGGGCC TCCGGGTTCCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGTGCAGTTTTGGCCAG GGGACCAAGCTGGAGATCAAAcgtacggtggccgctccctccgtg ttcatcttccccacttccgacgagcagctgaagtccggcaccgct tctgtcgtgtgcctgctgaacaacttctaccccgcgaggccaag gtgcagtggaaggtggacaacgccctgcagtccggcaactcccag gaatccgtgaccgagcaggactccaaggacagcacctactccctg tcctccaccctgaccctgtccaaggccgactacgagaagcacaag gtgtacgcctgcgaagtgacccaccagggcctgtctagccccgtg accaagtctttcaaccggggcgagtgt |

TABLE S2-continued

SEQ ID NOS: 343-538

| SEQ ID NO: | Name | Description | Sequence |
|---|---|---|---|
| 405 | STIM003 - CDRH1 using IMGT | Amino acid sequence of CDRH1 of STIM003 | GVTFDDYG |
| 406 | STIM003 - CDRH2 | Amino acid sequence of CDRH2 of STIM003 using IMGT | INWNGGDT |
| 407 | STIM003 - CDRH3 | Amino acid sequence of CDRH3 of STIM003 using IMGT | ARDFYGSGSYYHVPFDY |
| 408 | STIM003 - Heavy chain variable region | Amino acid sequence of $V_H$ of STIM003 | EVQLVESGGGVVRPGGSLRLSCVASGVTFDDYGMSWVRQAPGKGL EWVSGINWNGGDTDYSDSVKGRFTISRDNAKNSLYLQMNSLRAED TALYYCARDFYGSGSYYHVPFDYWGQGILVTVSS |
| 409 | STIM003 - Heavy chain variable region | Nucleic acid sequence of $V_H$ of STIM003 | GAGGTGCAGCTGGTGGAGTCTGGGGGAGGTGTGGTACGGCCTGGG GGGTCCCTGAGACTCTCCTGTGTAGCCTCTGGAGTCACCTTTGAT GATTATGGCATGAGCTGGGTCCGCCAAGCTCCAGGGAAGGGGCTG GARTGGGTCTCTGGTATTAATTGGAATGGTGGCGACACAGATTAT TCAGACTCTGTGAAGGGCCGATTCACCATCTCCAGAGACAACGCC AAGAACTCCCTGTATCTACAAATGAATAGTCTGAGAGCCGAGGAC ACGGCCTTGTATTACTGTGCGAGGGATTTCTATGGTTCGGGGAGT TATTATCACGTTCCTTTTGACTACTGGGGCCAGGGAATCCTGGTC ACCGTCTCCTCA |
| 410 | STIM003 - full heavy chain sequence | Amino acid sequence of STIM003 heavy chain | EVQLVESGGGVVRPGGSLRLSCVASGVTFDDYGMSWVRQAPGKGL EWVSGINWNGGDTDYSDSVKGRFTISRDNAKNSLYLQMNSLRAED TALYYCARDFYGSGSYYHVPFDYWGQGILVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 411 | STIM003 - full heavy chain sequence | Nucleic acid sequence of STIM003 heavy chain | GAGGTGCAGCTGGTGGAGTCTGGGGGAGGTGTGGTACGGCCTGGG GGGTCCCTGAGACTCTCCTGTGTAGCCTCTGGAGTCACCTTTGAT GATTATGGCATGAGCTGGGTCCGCCAAGCTCCAGGGAAGGGGCTG GARTGGGTCTCTGGTATTAATTGGAATGGTGGCGACACAGATTAT TCAGACTCTGTGAAGGGCCGATTCACCATCTCCAGAGACAACGCC AAGAACTCCCTGTATCTACAAATGAATAGTCTGAGAGCCGAGGAC ACGGCCTTGTATTACTGTGCGAGGGATTTCTATGGTTCGGGGAGT TATTATCACGTTCCTTTTGACTACTGGGGCCAGGGAATCCTGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |

TABLE S2-continued

SEQ ID NOS: 343-538

| SEQ ID NO: | Name | Description | Sequence |
|---|---|---|---|
| 412 | STIM003 - CDRL1 | Amino acid sequence of CDRL1 of STIM003 using IMGT | QSVSRSY |
| 413 | STIM003 - CDRL2 | Amino acid sequence of CDRL2 of STIM003 using IMGT | GAS |
| 414 | STIM003 - CDRL3 | Amino acid sequence of CDRL3 of STIM003 using IMGT | HQYDMSPFT |
| 415 | STIM003 - Light chain variable region | Amino acid sequence of $V_L$ of STIM003 | EIVLTQSPGTLSLSPGERATLSCRASQSVSRSYLAWYQQKRGQAP RLLIYGASSRATGIPDRFSGDGSGTDFTLSISRLEPEDFAVYYCH QYDMSPFTFGPGTKVDIK |
| 416 | STIM003 - Light chain variable region | Nucleic acid sequence of $V_L$ of STIM003 | GAAATTGTGTTGACGCAGTCTCCAGGGACCCTGTCTTTGTCTCCA GGGGAAAGAGCCACCCTCTCCTGCAGGGCCAGTCAGAGTGTTAGC AGAAGCTACTTAGCCTGGTACCAGCAGAAACGTGGCCAGGCTCCC AGGCTCCTCATCTATGGTGCATCCAGCAGGGCCACTGGCATCCCA GACAGGTTCAGTGGCGATGGGTCTGGGACAGACTTCACTCTCTCC ATCAGCAGACTGGAGCCTGAAGATTTTGCAGTGTATTACTGTCAC CAGTATGATATGTCACCATTCACTTTCGGCCCTGGGACCAAAGTG GATATCAAA |
| 417 | STIM003 - full light chain sequence | Amino acid sequence of STIM003 light chain | EIVLTQSPGTLSLSPGERATLSCRASQSVSRSYLAWYQQKRGQAP RLLIYGASSRATGIPDRFSGDGSGTDFTLSISRLEPEDFAVYYCH QYDMSPFTFGPGTKVDIKRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC |
| 418 | STIM003 - full light chain sequence | Nucleic acid sequence of STIM003 light chain | GAAATTGTGTTGACGCAGTCTCCAGGGACCCTGTCTTTGTCTCCA GGGGAAAGAGCCACCCTCTCCTGCAGGGCCAGTCAGAGTGTTAGC AGAAGCTACTTAGCCTGGTACCAGCAGAAACGTGGCCAGGCTCCC AGGCTCCTCATCTATGGTGCATCCAGCAGGGCCACTGGCATCCCA GACAGGTTCAGTGGCGATGGGTCTGGGACAGACTTCACTCTCTCC ATCAGCAGACTGGAGCCTGAAGATTTTGCAGTGTATTACTGTCAC CAGTATGATATGTCACCATTCACTTTCGGCCCTGGGACCAAAGTG GATATCAAAcgtacggtggccgctcccrcgtgttcatcttccca ccttccgacgagcagctgaagtccggcaccgcttctgtcgtgtgc ctgctgaacaacttctaccccgcgaggccaaggtgcagtggaag gtggacaacgccctgcagtccggcaactcccaggaatccgtgacc gagcaggactccaaggacagcacctactccctgtcctccaccctg accctgtccaaggccgactacgagaagcacaaggtgtacgcctgc gaagtgacccaccagggcctgtctagccccgtgaccaagtctttc aaccggggcgagtgt |
| 419 | STIM004 - CDRH1 | Amino acid sequence of CDRH1 of STIM004 using IMGT | GLTFDDYG |
| 420 | STIM004 - CDRH2 | Amino acid sequence of CDRH2 of STIM004 using IMGT | INWNGDNT |
| 421 | STIM004 - CDRH3 | Amino acid sequence of CDRH3 of STIM004 using IMGT | ARDYYGSGSYYNVPFDY |
| 422 | STIM004 - Heavy chain variable region | Amino acid sequence of $V_H$ of STIM004 | EVQLVESGGGVVRPGGSLRLSCAASGLTFDDYGMSWVRQVPGKGL EWVSGINWNGDNTDYADSVKGRFTISRDNAKNSLYLQMNSLRAED TALYYCARDYYGSGSYYNVPFDYWGQGTLVTVSS |
| 423 | STIM004 - Heavy chain variable region | Nucleic acid sequence of $V_H$ of STIM004 | GAGGTGCAGCTGGTGGAGTCTGGGGGAGGTGTGGTACGGCCTGGG GGGTCCCTGAGACTCTCCTGTGCAGCCTCTGGACTCACCTTTGAT GATTATGGCATGAGCTGGGTCCGCCAAGTTCCAGGGAAGGGGCTG GAGTGGGTCTCTGGTATTAATTGGAATGGTGATAACACAGATTAT GCAGACTCTGTGAAGGGCCGATTCACCATCTCCAGAGACAACGCC AAGAACTCCCTGTATCTGCAAATGAACAGTCTGAGAGCCGAGGAC |

TABLE S2-continued

SEQ ID NOS: 343-538

| SEQ ID NO: | Name | Description | Sequence |
|---|---|---|---|
| | | | ACGGCCTTGTATTACTGTGCGAGGGATTACTATGGTTCGGGGAGT<br>TATTATAACGTTCCTTTTGACTACTGGGGCCAGGGAACCCTGGTC<br>ACCGTCTCCTCA |
| 424 | STIM004 - full heavy chain sequence | Amino acid sequence of STIM004 heavy chain | EVQLVESGGGVVRPGGSLRLSCAASGLTFDDYGMSWVRQVPGKGL<br>EWVSGINWNGDNTDYADSVKGRFTISRDNAKNSLYLQMNSLRAED<br>TALYYCARDYYGSGSYYNVPFDYWGQGTLVTVSSASTKGPSVFPL<br>APSSKSTSGGTAALGCLVKDYFPEPVTVSWNSGALTSGVHTFPAV<br>LQSSGLYSLSSVVTVPSSSLGTQTYICNVNHKPSNTKVDKKVEPK<br>SCDKTHTCPPCPAPELLGGPSVFLFPPKPKDTLMISRTPEVTCVV<br>VDVSHEDPEVKFNWYVDGVEVHNAKTKPREEQYNSTYRVVSVLTV<br>LHQDWLNGKEYKCKVSNKALPAPIEKTISKAKGQPREPQVYTLPP<br>SRDELTKNQVSLTCLVKGFYPSDIAVEWESNGQPENNYKTTPPVL<br>DSDGSFFLYSKLTVDKSRWQQGNVFSCSVMHEALHNHYTQKSLSL<br>SPGK |
| 425 | STIM004 - full heavy chain sequence | Nucleic acid sequence of STIM004 heavy chain | GAGGTGCAGCTGGTGGAGTCTGGGGGAGGTGTGGTACGGCCTGGG<br>GGGTCCCTGAGACTCTCCTGTGCAGCCTCTGGACTCACCTTTGAT<br>GATTATGGCATGAGCTGGGTCCGCCAAGTTCCAGGGAAGGGGCTG<br>GAGTGGGTCTCTGGTATTAATTGGAATGGTGATAACACAGATTAT<br>GCAGACTCTGTGAAGGGCCGATTCACCATCTCCAGAGACAACGCC<br>AAGAACTCCCTGTATCTGCAAATGAACAGTCTGAGAGCCGAGGAC<br>ACGGCCTTGTATTACTGTGCGAGGGATTACTATGGTTCGGGGAGT<br>TATTATAACGTTCCTTTTGACTACTGGGGCCAGGGAACCCTGGTC<br>ACCGTCTCCTCAGCCAGCACCAAGGGCCCCTCTGTGTTCCCTCTG<br>GCCCCTTCCAGCAAGTCCACCTCTGGCGGAACAGCCGCTCTGGGC<br>TGCCTCGTGAAGGACTACTTCCCCGAGCCTGTGACCGTGTCCTGG<br>AACTCTGGCGCTCTGACCAGCGGAGTGCACACCTTCCCTGCTGTG<br>CTGCAGTCCTCCGGCCTGTACTCCCTGTCCTCCGTCGTGACCGTG<br>CCTTCCAGCTCTCTGGGCACCCAGACCTACATCTGCAACGTGAAC<br>CACAAGCCCTCCAACACCAAGGTGGACAAGAAGGTGGAACCCAAG<br>TCCTGCGACAAGACCCACACCTGTCCCCCTTGTCCTGCCCCTGAA<br>CTGCTGGGCGGACCTTCCGTGTTCCTGTTCCCCCCAAAGCCCAAG<br>GACACCCTGATGATCTCCCGGACCCCCGAAGTGACCTGCGTGGTG<br>GTGGATGTGTCCCACGAGGACCCTGAAGTGAAGTTCAATTGGTAC<br>GTGGACGGCGTGGAAGTGCACAACGCCAAGACCAAGCCTAGAGAG<br>GAACAGTACAACTCCACCTACCGGGTGGTGTCCGTGCTGACCGTG<br>CTGCACCAGGATTGGCTGAACGGCAAAGAGTACAAGTGCAAGGTG<br>TCCAACAAGGCCCTGCCTGCCCCCATCGAAAAGACCATCTCCAAG<br>GCCAAGGGCCAGCCCCGGGAACCCCAGGTGTACACACTGCCCCCT<br>AGCAGGGACGAGCTGACCAAGAACCAGGTGTCCCTGACCTGTCTC<br>GTGAAGGCTTCTACCCCTCCGATATCGCCGTGGAATGGGAGTCC<br>AACGGCCAGCCTGAGAACAACTACAAGACCACCCCCCCTGTGCTG<br>GACTCCGACGGCTCATTCTTCCTGTACAGCAAGCTGACAGTGGAC<br>AAGTCCCGGTGGCAGCAGGGCAACGTGTTCTCCTGCTCCGTGATG<br>CACGAGGCCCTGCACAACCACTACACCCAGAAGTCCCTGTCCCTG<br>AGCCCCGGCAAGTGATGA |
| 426 | STIM004 - CDRL1 | Amino acid sequence of CDRL1 of STIM004 using IMGT | QSVSSSY |
| 427 | STIM004 - CDRL2 | Amino acid sequence of CDRL2 of STIM004 using IMGT | GAS |
| 428 | STIM004 - CDRL3 | Amino acid sequence of CDRL3 of STIM004 using IMGT | QQYGSSPF |
| 429 | STIM004 - Corrected light chain variable region | Amino acid sequence of corrected $V_L$ of STIM004 | EIVLTQSPGTLSLSPGERATLSCRASQSVSSSYLAWYQQKPGQAP<br>RLLIYGASSRATGIPDRFSGSGSGTDFTLTIRRLEPEDFAVYYCQ<br>QYGSSPFFGPGTKVDIK |
| 430 | STIM004 - Corrected light chain variable | Nucleic acid sequence of corrected $V_L$ of STIM004 | GAAATTGTGTTGACGCAGTCTCCAGGCACCCTGTCTTTGTCTCCA<br>GGGGAAAGAGCCACCCTCTCCTGCAGGGCCAGTCAGAGTGTTAGC<br>AGCAGCTACTTAGCCTGGTACCAGCAGAAACCTGGCCAGGCTCCC<br>AGGCTCCTCATATATGGTGCATCCAGCAGGGCACTGGCATCCCA<br>GACAGGTTCAGTGGCAGTGGGTCTGGGACAGACTTCACTCTCACC |

TABLE S2-continued

SEQ ID NOS: 343-538

| SEQ ID NO: | Name | Description | Sequence |
|---|---|---|---|
| | region | | ATCAGAAGACTGGAGCCTGAAGATTTTGCAGTGTATTACTGTCAG CAGTATGGTAGTTCACCATTCTTCGGCCCTGGGACCAAAGTGGAT ATCAAA |
| 431 | STIM004 - Light chain variable region | Nucleic acid sequence of V$_L$ of STIM004 | GAAATTGTGTTGACGCAGTCTCCAGGCACCCTGTCTTTGTCTCCA GGGGAAAGAGCCACCCTCTCCTGCAGGGCCAGTCAGAGTGTTAGC AGCAGCTACTTAGCCTGGTACCAGCAGAAACCTGGCCAGGCTCCC AGGCTCCTCATATATGGTGCATCCAGCAGGGCCACTGGCATCCCA GACAGGTTCAGTGGCAGTGGGTCTGGGACAGACTTCACTCTCACC ATCAGAAGACTGGAGCCTGAAGATTTTGCAGTGTATTACTGTCAG CAGTATGGTAGTTCACCATTCACTTCGGCCCTGGGACCAAAGTGG ATATCAAA |
| 432 | STIM004 - full corrected light chain sequence | Amino acid sequence of STIM004 light chain | EIVLTQSPGTLSLSPGERATLSCRASQSVSSSYLAWYQQKPGQAP RLLIYGASSRATGIPDRFSGSGSGTDFTLTIRRLEPEDFAVYYCQ QYGSSPFFGPGTKVDIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 433 | STIM004 - full corrected light chain sequence | Nucleic acid sequence of corrected STIM004 light chain | GAAATTGTGTTGACGCAGTCTCCAGGCACCCTGTCTTTGTCTCCA GGGGAAAGAGCCACCCTCTCCTGCAGGGCCAGTCAGAGTGTTAGC AGCAGCTACTTAGCCTGGTACCAGCAGAAACCTGGCCAGGCTCCC AGGCTCCTCATATATGGTGCATCCAGCAGGGCCACTGGCATCCCA GACAGGTTCAGTGGCAGTGGGTCTGGGACAGACTTCACTCTCACC ATCAGAAGACTGGAGCCTGAAGATTTTGCAGTGTATTACTGTCAG CAGTATGGTAGTTCACCATTCTTCGGCCCTGGGACCAAAGTGGAT ATCAAAcgtacggtggccgctcccctccgtgttcatcttcccaccttccgacgagcagctgaagtccggcaccgcttctgtcgtgtgcctgctgaacaacttctaccccgcgaggccaaggtgcagtggaaggtggacaacgccctgcagtccggcaactcccaggaatccgtgaccgagcaggactccaaggacagcacctactcccttgtcctccaccctgaccctgtccaaggccgactacgagaagcacaaggtgtacgcctgcgaagtgacccaccagggcctgtctagccccgtgaccaagtctttcaaccggggcgagtgt |
| 434 | STIM004 - full light chain sequence | Nucleic acid sequence of STIM004 light chain | GAAATTGTGTTGACGCAGTCTCCAGGCACCCTGTCTTTGTCTCCA GGGGAAAGAGCCACCCTCTCCTGCAGGGCCAGTCAGAGTGTTAGC AGCAGCTACTTAGCCTGGTACCAGCAGAAACCTGGCCAGGCTCCC AGGCTCCTCATATATGGTGCATCCAGCAGGGCCACTGGCATCCCA GACAGGTTCAGTGGCAGTGGGTCTGGGACAGACTTCACTCTCACC ATCAGAAGACTGGAGCCTGAAGATTTTGCAGTGTATTACTGTCAG CAGTATGGTAGTTCACCATTCACTTCGGCCCTGGGACCAAAGTGG ATATCAAAcgtacggtggccgctcccctccgtgttcatcttcccaccttccgacgagcagctgaagtccggcaccgcttctgtcgtgtgcctgctgaacaacttctaccccgcgaggccaaggtgcagtggaaggtggacaacgccctgcagtccggcaactcccaggaatccgtgaccgagcaggactccaaggacagcacctactcccttgtcctccaccctgaccctgtccaaggccgactacgagaagcacaaggtgtacgcctgcgaagtgacccaccagggcctgtctagccccgtgaccaagtctttcaaccggggcgagtgt |
| 435 | STIM005 - CDRH1 | Amino acid sequence of CDRH1 of STIM005 using IMGT | GYTFNSYG |
| 436 | STIM005 - CDRH2 | Amino acid sequence of CDRH2 of STIM005 using IMGT | ISVHNGNT |
| 437 | STIM005 - CDRH3 | Amino acid sequence of CDRH3 of STIM005 using IMGT | ARAGYDILTDFSDAFDI |
| 438 | STIM005 - Heavy chain variable region | Amino acid sequence of V$_H$ of STIM005 | QVQLVQSGAEVKKPGASVKVSCKASGYTFNSYGIIWVRQAPGQGL EWMGWISVHNGNTNCAQKLQGRVTMTTDTSTSTAYMELRSLRTDD TAVYYCARAGYDILTDFSDAFDIWGHGTMVTVSS |
| 439 | STIM005 - Heavy chain variable region | Nucleic acid sequence of V$_H$ of STIM005 | CAGGTTCAGTTGGTGCAGTCTGGAGCTGAGGTGAAGAAGCCTGGG GCCTCAGTGAAGGTCTCCTGCAAGGCTTCTGGTTACACCTTTAAT AGTTATGGTATCATCTGGGTGCGACAGGCCCCTGGACAAGGGCTT GAGTGGATGGGATGGATCAGCGTTCACAATGGTAACACAAACTGT |

TABLE S2-continued

SEQ ID NOS: 343-538

| SEQ ID NO: | Name | Description | Sequence |
|---|---|---|---|
| | region | | GCACAGAAGCTCCAGGGTAGAGTCACCATGACCACAGACACATCC ACGAGCACAGCCTACATGGAGCTGAGGAGCCTGAGAACTGACGAC ACGGCCGTGTATTACTGTGCGAGAGCGGGTTACGATATTTTGACT GATTTTTCCGATGCTTTTGATATCTGGGGCCACGGGACAATGGTC ACCGTCTCTTCA |
| 440 | STIM005 - full heavy chain sequence | Amino acid sequence of STIM005 heavy chain | QVQLVQSGAEVKKPGASVKVSCKASGYTFNSYGIIWVRQAPGQGL EWMGWISVHNGNTNCAQKLQGRVTMTTDTSTAYMELRSLRTDD TAVYYCARAGYDILTDFSDAFDIWGHGTMVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 441 | STIM005 - full heavy chain sequence | Nucleic acid sequence of STIM005 heavy chain | CAGGTTCAGTTGGTGCAGTCTGGAGCTGAGGTGAAGAAGCCTGGG GCCTCAGTGAAGGTCTCCTGCAAGGCTTCTGGTTACACCTTTAAT AGTTATGGTATCATCTGGGTGCGACAGGCCCCTGGACAAGGGCTT GAGTGGATGGGATGGATCAGCGTTCACAATGGTAACACAAACTGT GCACAGAAGCTCCAGGGTAGAGTCACCATGACCACAGACACATCC ACGAGCACAGCCTACATGGAGCTGAGGAGCCTGAGAACTGACGAC ACGGCCGTGTATTACTGTGCGAGAGCGGGTTACGATATTTTGACT GATTTTTCCGATGCTTTTGATATCTGGGGCCACGGGACAATGGTC ACCGTCTCTTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |
| 442 | STIM005 - CDRL1 | Amino acid sequence of CDRL1 of STIM005 using IMGT | QNINNF |
| 443 | STIM005 - CDRL2 | Amino acid sequence of CDRL2 of STIM005 using IMGT | AAS |
| 444 | STIM005 - CDRL3 | Amino acid sequence of CDRL3 of STIM005 using IMGT | QQSYGIPW |
| 445 | STIM005 - Light chain variable region | Amino acid sequence of $V_L$ of STIM005 | DIQMTQSPSSLSASVGDRVTITCRASQNINNFLNWYQQKEGKGPK LLIYAASSLQRGIPSTFSGSGSGTDFTLTISSLQPEDFATYICQ4 SYGIPWVGQGTKVEIK |
| 446 | STIM005 - Light chain variable region | Nucleic acid sequence of $V_L$ of STIM005 | GACATCCAGATGACCCAGTCTCCATCCTCCCTGTCTGCATCTGTA GGAGACAGAGTCACCATCACTTGCCGGGCAAGTCAGAACATTAAT AACTTTTTAAATTGGTATCAGCAGAAAGAAGGGAAAGGCCCTAAG CTCCTGATCTATGCAGCATCCAGTTTGCAAAGAGGGATACCATCA ACGTTCAGTGGCAGTGGATCTGGGACAGACTTCACTCTCACCATC AGCAGTCTGCAACCTGAAGATTTTGCAACTTACATCTGTCAACAG |

TABLE S2-continued

SEQ ID NOS: 343-538

| SEQ ID NO: | Name | Description | Sequence |
|---|---|---|---|
| | | | AGCTACGGTATCCCGTGGGTCGGCCAAGGGACCAAGGTGGAAATC AAA |
| 447 | STIM005 - full light chain sequence | Amino acid sequence of STIM005 light chain | DIQMTQSPSSLSASVGDRVTITCRASQNINNFLNWYQQKEGKGPK LLIYAASSLQRGIPSTFSGSGSGTDFTLTISSLQPEDFATYICQQ SYGIPWVGQGTKVEIKRTVAAPSVFIFPPSDEQLKSGTASVVCLL NNFYPREAKVQWKVDNALQSGNSQESVTEQDSKDSTYSLSSTLTL SKADYEKHKVYACEVTHQGLSSPVTKSFNRGEC |
| 448 | STIM005 - full light chain sequence | Nucleic acid sequence of STIM005 light chain | GACATCCAGATGACCCAGTCTCCATCCTCCCTGTCTGCATCTGTA GGAGACAGAGTCACCATCACTTGCCGGGCAAGTCAGAACATTAAT AACTTTTTAAATTGGTATCAGCAGAAAGAAGGGAAAGGCCCTAAG CTCCTGATCTATGCAGCATCCAGTTTGCAAAGAGGGGATACCATCA ACGTTCAGTGGCAGTGGATCTGGGACAGACTTCACTCTCACCATC AGCAGTCTGCAACCTGAAGATTTTGCAACTTACATCTGTCAACAG AGCTACGGTATCCCGTGGGTCGGCCAAGGGACCAAGGTGGAAATC AAAcgtacggtggccgctcccTcgtgttcatcttcccacctTcc gacgagcagctgaagtccggcaccgcttctgtcgtgtgcctgctg aacaacttctaccccCgcgaggccaaggtgcagtggaaggtggac aacgccctgcagtccggcaactcccaggaatcgtgaccgagcag gactccaaggacagcacctactcctgtcctccaccctgaccctg tccaaggcgactacgagaagcacaaggtgtacgcctgcgaagtg acccaccagggcctgtctagccccgtgaccaagtctttcaaccgg ggcgagtgt |
| 449 | STIM006 - CDRH1 | Amino acid sequence of CDRH1 of STIM006 using IMGT | GFTFSDYF |
| 450 | STIM006 - CDRH2 | Amino acid sequence of CDRH2 of STIM006 using IMGT | ISSSGSTI |
| 451 | STIM006 - CDRH3 | Amino acid sequence of CDRH3 of STIM006 using IMGT | ARDHYDGSGIYPLYYYYGLDV |
| 452 | STIM006 - Heavy chain variable region | Amino acid sequence of $V_H$ of STIM006 | QVQLVESGGGLVKPGGSLRLSCAASGFTESDYFMSWIRQAPGKGL EWISYISSSGSTIYYADSVRGRFTISRDNAKYSLYLQMNSLRSED TAVYYCARDHYDGSGIYPLYYYYGLDVWGQGTTVTVSS |
| 453 | STIM006 - Heavy chain variable region | Nucleic acid sequence of $V_H$ of STIM006 | CAGGTGCAGCTGGTGGAGTCTGGGGGAGGCTTGGTCAAGCCTGGA GGGTCCCTGAGACTCTCCTGTGCAGCCTCTGGATTCACCTTCAGT GACTACTTCATGAGCTGGATCCGCCAGGCGCCAGGGAAGGGGCTG GAGTGGATTTCATACATTAGTTCTAGTGGTAGTACCATATACTAC GCAGACTCTGTGAGGGGCCGATTCACCATCTCCAGGGACAACGCC AAGTACTCACTGTATCTGCAAATGAACAGCCTGAGATCCGAGGAC ACGGCCGTGTATTACTGTGCGAGAGATCACTACGATGGTTCGGGG ATTTATCCCCTCTACTACTATTACGGTTTGGACGTCTGGGGCCAG GGGACCACGGTCACCGTCTCCTCA |
| 454 | STIM006 - full heavy chain sequence | Amino acid sequence of STIM006 heavy chain | QVQLVESGGGLVKPGGSLRLSCAASGFTFSDYFMSWIRQAPGKGL EWISYISSSGSTIYYADSVRGRFTISRDNAKYSLYLQMNSLRSED TAVYYCARDHYDGSGIYPLYYYYGLDVWGQGTTVTVSSASTKGPS VFPLAPSSKSTSGGTAALGCLVKDYFPEPVTVSWNSGALTSGVHT FPAVLQSSGLYSLSSVVTVPSSSLGTQTYICNVNHKPSNTKVDKK VEPKSCDKTHTCPPCPAPELLGGPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVY TLPPSRDELTKNQVSLTCLVKGFYPSDIAVEWESNGQPENNYKTT PPVLDSDGSFFLYSKLTVDKSRWQQGNVFSCSVMHEALHNHYTQK SLSLSPGK |
| 455 | STIM006 - full heavy chain sequence | Nucleic acid sequence of STIM006 heavy chain | CAGGTGCAGCTGGTGGAGTCTGGGGGAGGCTTGGTCAAGCCTGGA GGGTCCCTGAGACTCTCCTGTGCAGCCTCTGGATTCACCTTCAGT GACTACTTCATGAGCTGGATCCGCCAGGCGCCAGGGAAGGGGCTG GAGTGGATTTCATACATTAGTTCTAGTGGTAGTACCATATACTAC GCAGACTCTGTGAGGGGCCGATTCACCATCTCCAGGGACAACGCC AAGTACTCACTGTATCTGCAAATGAACAGCCTGAGATCCGAGGAC ACGGCCGTGTATTACTGTGCGAGAGATCACTACGATGGTTCGGGG ATTTATCCCCTCTACTACTATTACGGTTTGGACGTCTGGGGCCAG GGGACCACGGTCACCGTCTCCTCAGCCAGCACCAAGGGCCCCTCT |

TABLE S2-continued

SEQ ID NOS: 343-538

| SEQ ID NO: | Name | Description | Sequence |
|---|---|---|---|
| | | | GTGTTCCCTCTGGCCCCTTCCAGCAAGTCCACCTCTGGCGGAACA<br>GCCGCTCTGGGCTGCCTCGTGAAGGACTACTTCCCCGAGCCTGTG<br>ACCGTGTCCTGGAACTCTGGCGCTCTGACCAGCGGAGTGCACACC<br>TTCCCTGCTGTGCTGCAGTCCTCCGGCCTGTACTCCCTGTCCTCC<br>GTCGTGACCGTGCCTTCCAGCTCTCTGGGCACCCAGACCTACATC<br>TGCAACGTGAACCACAAGCCCTCCAACACCAAGGTGGACAAGAAG<br>GTGGAACCCAAGTCCTGCGACAAGACCCACACCTGTCCCCCTTGT<br>CCTGCCCCTGAACTGCTGGGCGGACCTTCCGTGTTCCTGTTCCCC<br>CCAAAGCCCAAGGACACCCTGATGATCTCCCGGACCCCCGAAGTG<br>ACCTGCGTGGTGGTGGATGTGTCCCACGAGGACCCTGAAGTGAAG<br>TTCAATTGGTACGTGGACGGCGTGGAAGTGCACAACGCCAAGACC<br>AAGCCTAGAGAGGAACAGTACAACTCCACCTACCGGGTGGTGTCC<br>GTGCTGACCGTGCTGCACCAGGATTGGCTGAACGGCAAGGAGTAC<br>AAGTGCAAGGTGTCCAACAAGGCCCTGCCTGCCCCCATCGAAAAG<br>ACCATCTCCAAGGCCAAGGGCCAGCCCCGGGAACCCCAGGTGTAC<br>ACACTGCCCCCTAGCAGGGACGAGCTGACCAAGAACCAGGTGTCC<br>CTGACCTGTCTCGTGAAAGGCTTCTACCCCTCCGATATCGCCGTG<br>GAATGGGAGTCCAACGGCCAGCCTGAGAACAACTACAAGACCACC<br>CCCCCTGTGCTGGACTCCGACGGCTCATTCTTCCTGTACAGCAAG<br>CTGACAGTGGACAAGTCCCGGTGGCAGCAGGGCAACGTGTTCTCC<br>TGCTCCGTGATGCACGAGGCCCTGCACAACCACTACACCCAGAAG<br>TCCCTGTCCCTGAGCCCCGGCAAGTGATGA |
| 456 | STIM006 - CDRL1 | Amino acid sequence of CDRL1 of STIM006 using IMGT | QSLLHSNGYNY |
| 457 | STIM006 - CDRL2 | Amino acid sequence of CDRL2 of STIM006 using IMGT | LGS |
| 458 | STIM006 - CDRL3 | Amino acid sequence of CDRL3 of STIM006 using IMGT | MQALQTPRS |
| 459 | STIM006 - Light chain variable region | Amino acid sequence of $V_L$ of STIM006 | IVMTQSPLSLPVTPGEPASISCRSSQSLLHSNGYNYLDYYLQKPG<br>QSPQLLIYLGSYRASGVPDRFSGSGSGTDFTLKISRVEAEDVGVY<br>YCMQALQTPRSFGQGTTLEIK |
| 460 | STIM006 - Light chain variable region | Nucleic acid sequence of $V_L$ of STIM006 | ATTGTGATGACTCAGTCTCCACTCTCCCTACCCGTCACCCCTGGA<br>GAGCCGGCCTCCATCTCCTGCAGGTCTAGTCAGAGCCTCCTGCAT<br>AGTAATGGATACAACTATTTGGATTATTACCTGCAGAAGCCAGGG<br>CAGTCTCCACAGCTCCTGATCTATTTGGGTTCTTATCGGGCCTCC<br>GGGGTCCCTGACAGGTTCAGTGGCAGTGGATCAGGCACAGATTTT<br>ACACTGAAAATCAGCAGAGTGGAGGCTGAGGATGTTGGGGTTTAT<br>TACTGCATGCAAGCTCTACAAACTCCTCGCAGTTTTGGCCAGGGG<br>ACCACGCTGGAGATCAAA |
| 461 | STIM006 - full light chain sequence | Amino acid sequence of STIM006 light chain | IVMTQSPLSLPVTPGEPASISCRSSQSLLHSNGYNYLDYYLQKPG<br>QSPQLLIYLGSYRASGVPDRFSGSGSGTDFTLKISRVEAEDVGVY<br>YCMQALQTPRSFGQGTTLEIKRTVAAPSVFIFPPSDEQLKSGTAS<br>VVCLLNNFYPREAKVQWKVDNALQSGNSQESVTEQDSKDSTYSLS<br>STLTLSKADYEKHKVYACEVTHQGLSSPVTKSFNRGEC |
| 462 | STIM006 - full light chain sequence | Nucleic acid sequence of STIM006 light chain | ATTGTGATGACTCAGTCTCCACTCTCCCTACCCGTCACCCCTGGA<br>GAGCCGGCCTCCATCTCCTGCAGGTCTAGTCAGAGCCTCCTGCAT<br>AGTAATGGATACAACTATTTGGATTATTACCTGCAGAAGCCAGGG<br>CAGTCTCCACAGCTCCTGATCTATTTGGGTTCTTATCGGGCCTCC<br>GGGGTCCCTGACAGGTTCAGTGGCAGTGGATCAGGCACAGATTTT<br>ACACTGAAAATCAGCAGAGTGGAGGCTGAGGATGTTGGGGTTTAT<br>TACTGCATGCAAGCTCTACAAACTCCTCGCAGTTTTGGCCAGGGG<br>ACCACGCTGGAGATCAAAcgtacggtggccgctcccctcgtgttc<br>atcttcccaccttccgacgagcagctgaagtccggcaccgcttct<br>gtcgtgtgcctgctgaacaacttctaccccgcgaggccaaggtg<br>cagtggaaggtggacaacgcccgcagtccggcaactcccaggaa<br>tccgtgaccgagcaggactccaaggacagcacctactccctgtcc<br>tccaccctgaccctgtccaaggccgactacgagaagcacaaggtg<br>tacgcctgcgaagtgacccaccagggcctgtctagccccgtgacc<br>aagtctttcaaccggggcgagtgt |

TABLE S2-continued

SEQ ID NOS: 343-538

| SEQ ID NO: | Name | Description | Sequence |
| --- | --- | --- | --- |
| 463 | STIM007 - CDRH1 | Amino acid sequence of CDRH1 of STIM007 using IMGT | GFSLSTTGVG |
| 464 | STIM007 - CDRH2 | Amino acid sequence of CDRH2 of STIM007 using IMGT | IYWDDDK |
| 465 | STIM007 - CDRH3 | Amino acid sequence of CDRH3 of STIM007 using IMGT | THGYGSASYYHYGMDV |
| 466 | STIM007 - Heavy chain variable region | Amino acid sequence of $V_H$ of STIM007 | QITLKESGPTLVKPTQTLTLTCTFSGFSLSTTGVGVGWIRQPPGK ALEWLAVIYWDDDKRYSPSLKSRLTITKDTSKNQVVLTMTNMDPV DTATYFCTHGYGSASYYHYGMDVWGQGTTVTVSS |
| 467 | STIM007 - Heavy chain variable region | Nucleic acid sequence of $V_H$ of STIM007 | CAGATCACCTTGAAGGAGTCTGGTCCTACGCTGGTGAAACCCACA CAGACCCTCACGCTGACCTGCACCTTCTCTGGGTTCTCACTCAGC ACTACTGGAGTGGGTGTGGGCTGGATCCGTCAGCCCCCAGGAAAG GCCCTGGAGTGGCTTGCAGTCATTTATTGGGATGATGATAAGCGC TACAGCCCATCTCTGAAGAGCAGACTCACCATCACCAAGGACACC TCCAAAAACCAGGTGGTCCTTACAATGACCAACATGGACCCTGTG GACACAGCCACATATTTCTGTACACACGGATATGGTTCGGCAGT TATTACCACTACGGTATGGACGTCTGGGGCCAAGGGACCACGGTC ACCGTCTCCTCA |
| 468 | STIM007 - full heavy chain sequence | Amino acid sequence of STIM007 heavy chain | QITLKESGPTLVEPTQTLTLTCTFSGESLSTTGVGVGWIRQPPGK ALEWLAVIYWDDDKRYSPSLKSRLTITKDTSKNQVVLTMTNMDPV DTATYFCTHGYGSASYYHYGMDVWGQGTTVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 469 | STIM007 - full heavy chain sequence | Nucleic acid sequence of STIM007 heavy chain | CAGATCACCTTGAAGGAGTCTGGTCCTACGCTGGTGAAACCCACA CAGACCCTCACGCTGACCTGCACCTTCTCTGGGTTCTCACTCAGC ACTACTGGAGTGGGTGTGGGCTGGATCCGTCAGCCCCCAGGAAAG GCCCTGGAGTGGCTTGCAGTCATTTATTGGGATGATGATAAGCGC TACAGCCCATCTCTGAAGAGCAGACTCACCATCACCAAGGACACC TCCAAAAACCAGGTGGTCCTTACAATGACCAACATGGACCCTGTG GACACAGCCACATATTTCTGTACACACGGATATGGTTCGGCAGT TATTACCACTACGGTATGGACGTCTGGGGCCAAGGGACCACGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |

TABLE S2-continued

SEQ ID NOS: 343-538

| SEQ ID NO: | Name | Description | Sequence |
|---|---|---|---|
| 470 | STIM007 - CDRL1 | Amino acid sequence of CDRL1 of STIM007 using IMGT | QSVTNY |
| 471 | STIM007 - CDRL2 | Amino acid sequence of CDRL2 of STIM007 using IMGT | DAS |
| 472 | STIM007 - CDRL3 | Amino acid sequence of CDRL3 of STIM007 using IMGT | QHRSNWPLT |
| 473 | STIM007 - Light chain variable region | Amino acid sequence of $V_L$ of STIM007 | EIVLTQSPATLSLSPGERATLSCRASQSVTNYLAWHQQKPGQAPR LLIYDASNRATGIPARFSGSGSGTDFTLTISSLEPEDFAVYYCQH RSNWPLTFGGGTKVEIK |
| 474 | STIM007 - Light chain variable region | Nucleic acid sequence of $V_L$ of STIM007 | GAAATTGTATTGACACAGTCTCCAGCCACCCTGTCTTTGTCTCCA GGGGAAAGAGCCACCCTCTCCTGCAGGGCCAGTCAGAGTGTTACC AACTACTTAGCCTGGCACCAACAGAAACCTGGCCAGGCTCCCAGG CTCCTCATCTATGATGCATCCAACAGGGCCACTGGCATCCCAGCC AGGTTCAGTGGCAGTGGGTCTGGGACAGACTTCACTCTCACCATC AGCAGCCTAGAGCCTGAAGATTTTGCAGTTTATTACTGTCAGCAC CGTAGCAACTGGCCTCTCACTTTCGGCGGAGGGACCAAGGTGGAG ATCAAAC |
| 475 | STIM007 - full light chain sequence | Amino acid sequence of STIM007 light chain | EIVLTQSPATLSLSPGERATLSCRASQSVTNYLAWHQQKPGQAPR LLIYDASNRATGIPARFSGSGSGTDFTLTISSLEPEDFAVYYCQH RSNWPLTFGGGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 476 | STIM007 - full light chain sequence | Nucleic acid sequence of STIM007 light chain | GAAATTGTATTGACACAGTCTCCAGCCACCCTGTCTTTGTCTCCA GGGGAAAGAGCCACCCTCTCCTGCAGGGCCAGTCAGAGTGTTACC AACTACTTAGCCTGGCACCAACAGAAACCTGGCCAGGCTCCCAGG CTCCTCATCTATGATGCATCCAACAGGGCCACTGGCATCCCAGCC AGGTTCAGTGGCAGTGGGTCTGGGACAGACTTCACTCTCACCATC AGCAGCCTAGAGCCTGAAGATTTTGCAGTTTATTACTGTCAGCAC CGTAGCAACTGGCCTCTCACTTTCGGCGGAGGGACCAAGGTGGAG ATCAAACcgtacggtggccgctcccgtcgtgttcatcttcccacc ttccgacgagcagctgaagtccggcaccgcttctgtcgtgtgcct gctgaacaacttctaccccgcgcgaggccaaggtgcagtggaaggt ggacaacgccctgcagtccggcaactcccaggaatccgtgaccga gcaggactccaaggacagcacctactccctgtcctccaccctgac cctgtccaaggccgactacgagaagcacaaggtgtacgcctgcga agtgacccaccagggcctgtctagccccgtgaccaagtctttcaa ccggggcgagtgt |
| 477 | STIM008 - CDRH1 | Amino acid sequence of CDRH1 of STIM008 using IMGT | GFSLSTSGVG |
| 478 | STIM008 - CDRH2 | Amino acid sequence of CDRH2 of STIM008 using IMGT | IYWDDDK |
| 479 | STIM008 - CDRH3 | Amino acid sequence of CDRH3 of STIM008 using IMGT | THGYGSASYYHYGMDV |
| 480 | STIM008 - Heavy chain variable region | Amino acid sequence of $V_H$ of STIM008 | QITLKESGPTLVKPTQTLTLTCTFSGFSLSTSGVGVGWIRQPPGK ALEWLAVIYWDDDKRYSPSLKSRLTITKDTSKNQVVLTMTNMDPV DTATYFCTHGYGSASYYHYGMDVWGQGTTVTVSS |
| 481 | STIM008 - Heavy chain variable region | Nucleic acid sequence of $V_H$ of STIM008 | CAGATCACCTTGAAGGAGTCTGGTCCTACGCTGGTGAAACCCACA CAGACCCTCACGCTGACCTGCACCTTCTCTGGGTTCTCACTCAGC ACTAGTGGAGTGGGTGTGGGCTGGATCCGTCAGCCCCCAGGAAAG GCCCTGGAGTGGCTTGCAGTCATTTATTGGGATGATGATAAGCGC TACAGCCCATCTCTGAAGAGCAGGCTCACCATCACCAAGGACACC TCCAAAAACCAGGTGGTCCTTACAATGACCAACATGGACCCTGTG |

TABLE S2-continued

SEQ ID NOS: 343-538

| SEQ ID NO: | Name | Description | Sequence |
|---|---|---|---|
| | | | GACACAGCCACATATTTCTGTACACACGGATATGGTTCGGCGAGT TATTACCACTACGGTATGGACGTCTGGGGCCAAGGGACCACGGTC ACCGTCTCCTCA |
| 482 | STIM008 - full heavy chain sequence | Amino acid sequence of STIM008 heavy chain | QITLKESGPTLVKPTQTLTLTCTFSGFSLSTSGVGVGWIRQPPGK ALEWLAVIYWDDDKRYSPSLKSRLTITKDTSKNQVVLTMTNMDPV DTATYFCTHGYGSASYYHYGMDVWGQGTTVTVSSASTKGPSVFPL APSSKSTSGGTAALGCLVKDYFPEPVTVSWNSGALTSGVHTFPAV LQSSGLYSLSSVVTVPSSSLGTQTYICNVNHKPSNTKVDKKVEPK SCDKTHTCPPCPAPELLGGPSVFLFPPKPKDTLMISRTPEVTCVV VDVSHEDPEVKFNWYVDGVEVHNAKTKPREEQYNSTYRVVSVLTV LHQDWLNGKEYKCKVSNKALPAPIEKTISKAKGQPREPQVYTLPP SRDELTKNQVSLTCLVKGFYPSDIAVEWESNGQPENNYKTTPPVL DSDGSFFLYSKLTVDKSRWQQGNVFSCSVMHEALHNHYTQKSLSL SPGK |
| 483 | STIM008 - full heavy chain sequence | Nucleic acid sequence of STIM008 heavy chain | CAGATCACCTTGAAGGAGTCTGGTCCTACGCTGGTGAAACCCACA CAGACCCTCACGCTGACCTGCACCTTCTCTGGGTTCTCACTCAGC ACTAGTGGAGTGGGTGTGGGCTGGATCCGTCAGCCCCCAGGAAAG GCCCTGGAGTGGCTTGCAGTCATTTATTGGGATGATGATAAGCGC TACAGCCCATCTCTGAAGAGCAGGCTCACCATCACCAAGGACACC TCCAAAAACCAGGTGGTCCTTACAATGACCAACATGGACCCTGTG GACACAGCCACATATTTCTGTACACACGGATATGGTTCGGCGAGT TATTACCACTACGGTATGGACGTCTGGGGCCAAGGGACCACGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |
| 484 | STIM008 - CDRL1 | Amino acid sequence of CDRL1 of STIM008 using IMGT | QSVTNY |
| 485 | STIM008 - CDRL2 | Amino acid sequence of CDRL2 of STIM008 using IMGT | DAS |
| 486 | STIM008 - CDRL3 | Amino acid sequence of CDRL3 of STIM008 using IMGT | QQRSNWPLT |
| 487 | STIM008 - Light chain variable region | Amino acid sequence of $V_L$ of STIM008 | EIVLTQSPATLSLSPGERATLSCRASQSVTNYLAWHQQKPGQAPR LLIYDASNRATGIPARFSGSGSGTDFTLTISSLEPEDFAVYYCQQ RSNWPLTFGGGTKVEIK |
| 488 | STIM008 - Light chain variable region | Nucleic acid sequence of $V_L$ of STIM008 | GAAATTGTGTTGACACAGTCTCCAGCCACCCTGTCTTTGTCTCCA GGGGAAAGAGCCACCCTCTCCTGCAGGGCCAGTCAGAGTGTTACC AACTACTTAGCCTGGCACCAACAGAAACCTGGCCAGGCTCCCAGG CTCCTCATCTATGATGCATCCAACAGGGCCACTGGCATCCCAGCC AGGTTCAGTGGCAGTGGGTCTGGGACAGACTTCACTCTCACCATC AGCAGCCTAGAGCCTGAAGATTTTGCAGTTTATTACTGTCAGCAG CGTAGCAACTGGCCTCTCACTTTCGGCGGAGGGACCAAGGTGGAG ATCAAA |

US 11,629,189 B2

217                                                                                                                                218

TABLE S2-continued

SEQ ID NOS: 343-538

| SEQ ID NO: | Name | Description | Sequence |
|---|---|---|---|
| 489 | STIM008 - full light chain sequence | Amino acid sequence of STIM008 light chain | EIVLTQSPATLSLSPGERATLSCRASQSVTNYLAWHQQKPGQAPR LLIYDASNRATGIPARFSGSGSGTDFTLTISSLEPEDFAVYYCQQ RSNWPLTFGGGTKVEIKRTVAAPSVFIFPPSDEQLKSGTASVVCL LNNFYPREAKVQWKVDNALQSGNSQESVTEQDSKDSTYSLSSTLT LSKADYEKHKVYACEVTHQGLSSPVTKSFNRGEC |
| 490 | STIM008 - full light chain sequence | Nucleic acid sequence of STIM008 light chain | GAAATTGTGTTGACACAGTCTCCAGCCACCCTGTCTTTGTCTCCA GGGGAAAGAGCCACCCTCTCCTGCAGGGCCAGTCAGAGTGTTACC AACTACTTAGCCTGGCACCAACAGAAACCTGGCCAGGCTCCCAGG CTCCTCATCTATGATGCATCCAACAGGGCCACTGGCATCCCAGCC AGGTTCAGTGGCAGTGGGTCTGGGACAGACTTCACTCTCACCATC AGCAGCCTAGAGCCTGAAGATTTTGCAGTTTATTACTGTCAGCAG CGTAGCAACTGGCCTCTCACTTTCGGCGGAGGGACCAAGGTGGAG ATCAAAcgtacggtggccgctcccctccgtgttcatcttcccacct tccgacgagcagctgaagtccggcaccgcttctgtcgtgtgcctg ctgaacaacttctacccccgcgaggccaaggtgcagtggaaggtg gacaacgccctgcagtccggcaactcccaggaatccgtgaccgag caggactccaaggacagcacctactccctgtcctccaccctgacc ctgtccaaggccgactacgagaagcacaaggtgtacgcctgcgaa gtgacccaccagggcctgtctagccccgtgaccaagtctttcaac cggggcgagtgt |
| 491 | STIM009 - CDRH1 | Amino acid sequence of CDRH1 of STIM009 using IMGT | GFTFSDYY |
| 492 | STIM009 - CDRH2 | Amino acid sequence of CDRH2 of STIM009 using IMGT | ISSSGSTI |
| 493 | STIM009 - CDRH3 | Amino acid sequence of CDRH3 of STIM009 using IMGT | ARDFYDILTDSPYFYYGVDV |
| 494 | STIM009 - Heavy chain variable region | Amino acid sequence of $V_H$ of STIM009 | QVQLVESGGGLVKPGGSLRLSCAASGFTFSDYYMSWIRQAPGKGL EWVSYISSSGSTIYYADSVKGRFTISRDNAKNSLYLQINSLRAED TAVYYCARDFYDILTDSPYFYYGVDVWGQGTTVTVSS |
| 495 | STIM009 - Heavy chain variable region | Nucleic acid sequence of $V_H$ of STIM009 | CAGGTGCAGCTGGTGGAGTCTGGGGGAGGCTTGGTCAAGCCTGGA GGGTCCCTGAGACTCTCCTGTGCAGCCTCTGGATTCACCTTCAGT GACTACTACATGAGCTGGATCCGCCAGGCTCCAGGGAAGGGGCTG GAGTGGGTTTCATACATTAGTAGTAGTGGTAGTACCATATACTAC GCAGACTCTGTGAAGGGCCGATTCACCATCTCCAGGGACAACGCC AAGAACTCACTGTATCTGCAAATTAACAGCCTGAGAGCCGAGGAC ACGGCCGTGTATTACTGTGCGAGAGATTTTTACGATATTTTGACT GATAGTCCGTACTTCTACTACGGTGTGGACGTCTGGGGCCAAGGG ACCACGGTCACCGTCTCCTCA |
| 496 | STIM009 - full heavy chain sequence | Amino acid sequence of STIM009 heavy chain | QVQLVESGGGLVKPGGSLRLSCAASGFTFSDYYMSWIRQAPGKGL EWVSYISSSGSTIYYADSVKGRFTISRDNAKNSLYLQINSLRAED TAVYYCARDFYDILTDSPYFYYGVDVWGQGTTVTVSSASTKGPSV FPLAPSSKSTSGGTAALGCLVKDYFPEPVTVSWNSGALTSGVHTF PAVLQSSGLYSLSSVVTVPSSSLGTQTYICNVNHKPSNTKVDKKV EPKSCDKTHTCPPCPAPELLGGPSVFLFPPKPKDTLMISRTPEVT CVVVDVSHEDPEVKFNWYVDGVEVHNAKTKPREEQYNSTYRVVSV LTVLHQDWLNGKEYKCKVSNKALPAPIEKTISKAKGQPREPQVYT LPPSRDELTKNQVSLTCLVKGFYPSDIAVEWESNGQPENNYKTTP PVLDSDGSFFLYSKLTVDKSRWQQGNVFSCSVMHEALHNHYTQKS LSLSPGK |
| 497 | STIM009 - full heavy chain sequence | Nucleic acid sequence of STIM009 heavy chain | CAGGTGCAGCTGGTGGAGTCTGGGGGAGGCTTGGTCAAGCCTGGA GGGTCCCTGAGACTCTCCTGTGCAGCCTCTGGATTCACCTTCAGT GACTACTACATGAGCTGGATCCGCCAGGCTCCAGGGAAGGGGCTG GAGTGGGTTTCATACATTAGTAGTAGTGGTAGTACCATATACTAC GCAGACTCTGTGAAGGGCCGATTCACCATCTCCAGGGACAACGCC AAGAACTCACTGTATCTGCAAATTAACAGCCTGAGAGCCGAGGAC ACGGCCGTGTATTACTGTGCGAGAGATTTTTACGATATTTTGACT GATAGTCCGTACTTCTACTACGGTGTGGACGTCTGGGGCCAAGGG ACCACGGTCACCGTCTCCTCAGCCAGCACCAAGGGCCCCTCTGTG TTCCCTCTGGCCCCTTCCAGCAAGTCCACCTCTGGCGGAACAGCC GCTCTGGGCTGCCTCGTGAAGGACTACTTCCCCGAGCCTGTGACC |

US 11,629,189 B2

TABLE S2-continued

SEQ ID NOS: 343-538

| SEQ ID NO: | Name | Description | Sequence |
|---|---|---|---|
| | | | GTGTCCTGGAACTCTGGCGCTCTGACCAGCGGAGTGCACACCTTC<br>CCTGCTGTGCTGCAGTCCTCCGGCCTGTACTCCCTGTCCTCCGTC<br>GTGACCGTGCCTTCCAGCTCTCTGGGCACCCAGACCTACATCTGC<br>AACGTGAACCACAAGCCCTCCAACACCAAGGTGGACAAGAAGGTG<br>GAACCCAAGTCCTGCGACAAGACCCACACCTGTCCCCCTTGTCCT<br>GCCCCTGAACTGCTGGGCGGACCTTCCGTGTTCCTGTTCCCCCCA<br>AAGCCCAAGGACACCCTGATGATCTCCCGGACCCCCGAAGTGACC<br>TGCGTGGTGGTGGATGTGTCCCACGAGGACCCTGAAGTGAAGTTC<br>AATTGGTACGTGGACGGCGTGGAAGTGCACAACGCCAAGACCAAG<br>CCTAGAGAGGAACAGTACAACTCCACCTACCGGGTGGTGTCCGTG<br>CTGACCGTGCTGCACCAGGATTGGCTGAACGGCAAAGAGTACAAG<br>TGCAAGGTGTCCAACAAGGCCCTGCCTGCCCCATCGAAAAGACC<br>ATCTCCAAGGCCAAGGGCCAGCCCCGGGAACCCCAGGTGTACACA<br>CTGCCCCCTAGCAGGGACGAGCTGACCAAGAACCAGGTGTCCCTG<br>ACCTGTCTCGTGAAAGGCTTCTACCCCTCCGATATCGCCGTGGAA<br>TGGGAGTCCAACGGCCAGCCTGAGAACAACTACAAGACCACCCCC<br>CCTGTGCTGGACTCCGACGGCTCATTCTTCCTGTACAGCAAGCTG<br>ACAGTGGACAAGTCCCGGTGGCAGCAGGGCAACGTGTTCTCCTGC<br>TCCGTGATGCACGAGGCCCTGCACAACCACTACACCCAGAAGTCC<br>CTGTCCCTGAGCCCCGGCAAGTGATGA |
| 498 | STIM009 - CDRL1 | Amino acid sequence of CDRL1 of STIM009 using IMGT | QSLLHSNGYNY |
| 499 | STIM009 - CDRL2 | Amino acid sequence of CDRL2 of STIM009 using IMGT | LGS |
| 500 | STIM009 - CDRL3 | Amino acid sequence Of CDRL3 of STIM009 using IMGT | MQALQTPRT |
| 501 | STIM009 - Light chain variable region | Amino acid sequence of $V_L$ of STIM009 | DIVMTQSPLSLPVTPGEPASISCRSSQSLLHSNGYNYLDWYLQKP<br>GQSPQLLIYLGSNRASGVPDRFSGSGSGTDFTLKISRVEAEDVGV<br>YYCMQALQTPRTFGQGTKVEIK |
| 502 | STIM009 - Light chain variable region | Nucleic acid sequence of $V_L$ of STIM009 | GATATTGTGATGACTCAGTCTCCACTCTCCCTGCCCGTCACCCCT<br>GGAGAGCCGGCCTCCATCTCCTGCAGGTCTAGTCAGAGCCTCCTG<br>CATAGTAATGGATACAACTATTTGGATTGGTACCTGCAGAAGCCA<br>GGGCAGTCTCCACAGCTCCTGATCTATTTGGGTTCTAATCGGGCC<br>TCCGGGGTCCCTGACAGGTTCAGTGGCAGTGGATCAGGCACAGAT<br>TTTACACTGAAAATCAGCAGAGTGGAGGCTGAGGATGTTGGGGTT<br>TATTACTGCATGCAAGCTCTACAAACTCCTCGGACGTTCGGCCAA<br>GGGACCAAGGTGGAAATCAAA |
| 503 | STIM009 - full light chain sequence | Amino acid sequence of STIM009 light chain | DIVMTQSPLSLPVTPGEPASISCRSSQSLLHSNGYNYLDWYLQKP<br>GQSPQLLIYLGSNRASGVPDRFSGSGSGTDFTLKISRVEAEDVGV<br>YYCMQALQTPRTFGQGTKVEIKRTVAAPSVFIFPPSDEQLKSGTA<br>SVVCLLNNFYPREAKVQWKVDNALQSGNSQESVTEQDSKDSTYSL<br>SSTLTLSKADYEKHKVYACEVTHQGLSSPVTKSFNRGEC |
| 504 | STIM009 - full light chain sequence | Nucleic acid sequence of STIM009 light chain | GATATTGTGATGACTCAGTCTCCACTCTCCCTGCCCGTCACCCCT<br>GGAGAGCCGGCCTCCATCTCCTGCAGGTCTAGTCAGAGCCTCCTG<br>CATAGTAATGGATACAACTATTTGGATTGGTACCTGCAGAAGCCA<br>GGGCAGTCTCCACAGCTCCTGATCTATTTGGGTTCTAATCGGGCC<br>TCCGGGGTCCCTGACAGGTTCAGTGGCAGTGGATCAGGCACAGAT<br>TTTACACTGAAAATCAGCAGAGTGGAGGCTGAGGATGTTGGGGTT<br>TATTACTGCATGCAAGCTCTACAAACTCCTCGGACGTTCGGCCAA<br>GGGACCAAGGTGGAAATCAAAcgtacggtggccgctccctccgtg<br>ttcatcttcccaccttccgacgagcagctgaagtccggcaccgct<br>tctgtcgtgtgcctgctgaacaacttctaccccgcgaggccaag<br>gtgcagtggaaggtggacaacgccctgcagtccggcaactcccag<br>gaatccgtgaccgagcaggactccaaggacagcacctactccctg<br>tcctccaccctgaccctgtccaaggccgactacgagaagcacaag<br>gtgtacgcctgcgaagtgacccaccagggcctgtctagccccgtg<br>accaagtctttcaaccggggcgagtgt |
| 505 | Human PD-L1 Flag His (KYPROT286) | Amino acid sequence of KYPROT286 with FLAG tag in bold and underlined and | FTVTVPKDLYVVEYGSNMTIECKFPVEKQLDLAALIVYWEMEDKN<br>IIQFVHGEEDLKVQHSSYRQRARLLKDQLSLGNAALQITDVKLQD<br>AGVYRCMISYGGADYKRITVKVNAPYNKINQRILVVDPVTSEHEL<br>TCQAEGYPKAEVIWTSSDHQVLSGKTTTTNSKREEKLFNVTSTLR |

TABLE S2-continued

SEQ ID NOS: 343-538

| SEQ ID NO: | Name | Description | Sequence |
|---|---|---|---|
| | | histidine tag in bold | INTTTNEIFYCTFRRLDPEENHTAELVIPELPLAHPPNERTIEGR DYEDDDDKHHHHHH |
| 506 | Mature human ICOS | Mature amino acid sequence of human ICOS | EINGSANYEMFIFHNGGVQILCKYPDIVQQFKMQLLKGGQILCDL TKTKGSGNTVSIKSLKFCHSQLSNNSVSFFLYNLDHSHANYYFCN LSIFDPPPFKVTLTGGYLHIYESQLCCQLKFWLPIGCAAFVVVCI LGCILICWLTKKKYSSSVHDPNGEYMFMRAVNTAKKSRLTDVTL |
| 507 | Human ICOS extracellular domain | Amino acid sequence of human ICOS extracellular domain | EINGSANYEMFIFHNGGVQILCKYPDIVQQFKMQLLKGGQILCDL TKTKGSGNTVSIKSLKFCHSQLSNNSVSFFLYNLDHSHANYYFCN LSIFDPPPFKVTLTGGYLHIYESQLCCQLKF |
| 508 | Human ICOS with signal peptide | Amino acid sequence of human ICOS (signal peptLde is underlined) | MKSGLWYFFLFCLRIKVLTGEINGSANYEMFIFHNGGVQILCKYP DIVQQFKMQLLKGGQILCDLTKTKGSGNTVSIKSLKFCHSQLSNN SVSFFLYNLDHSHANYYFCNLSIFDPPPFKVTLTGGYLHIYESQL CCQLKFWLPIGCAAFVVVCILGCILICWLTKKKYSSSVHDPNGEY MFMRAVNTAKKSRLTDVTL |
| 509 | Isoform of human ICOS (Q9Y6W8-2) | Amino acid sequence of a human ICOS isoform | The sequence of this isoform differs from the canonical sequence in its cytoplasmic domain as follows: 168-199: KYSSSVHDPNGEYMFMRAVNTAKKSRLTDVTLM |
| 510 | Mature mouse ICOS | Amino acid sequence of mature mouse ICOS | EINGSADHRMFSFHNGGVQISCKYPETVQQLKMRLFREREVLCEL TKTKGSGNAVSIKNPMLCLYHLSNNSVSFFLNNPDSSQGSYYFCS LSIFDPPPFQERNLSGGYLHIYESQLCCQLKIVVQVTE |
| 511 | Mouse ICOS extracellular domain | Amino acid sequence of the extracellular domain of mouse ICOS | EINGSADHRMFSFHNGGVQISCKYPETVQQLKMRLFREREVLCEL TKTKGSGNAVSIKNPMLCLYHLSNNSVSFFLNNPDSSQGSYYFCS LSIFDPPPFQERNLSGGYLHIYESQLCCQLK |
| 512 | Mouse ICOS with signal peptide | Amino acid sequence of mouse ICOS (signal peptide is underlined) | <u>MGWSCIILFLVATATGVHS</u>EINGSADHRMFSFHNGGVQISCKYPE TVQQLKMRLFREREVLCELTKTKGSGNAVSIKNPMLCLYHLSNNS VSFFLNNPDSSQGSYYFCSLSIFDPPPFQERNLSGGYLHIYESQL CCQLKIVVQVTE |
| 513 | Cynomolgus ICOS with signal peptide | Amino acid sequence of cynomolgus ICOS (signal peptide is underlined) | <u>MKSGLWYFFL FCLHMKVLTG</u> EINGSANYEM FIFHNGGVQI LCKYPDIVQQFKMQLLKGGQILCDLTKTKGSGNKVSIKSLKFCHS QLSNNSVSFFLYNLDRSHANYYFCNLSIFDPPPFKVTLTGGYLHI YESQLCCQLKFWLPIGCATFVVVCIFGCILICWLTKKKYSSTVHD PNGEYMFMRAVNTAKKSRLTGTTP |
| 514 | Cynomolgus ICOS extracellular domain | Amino acid sequence of cynomolgus ICOS extracellular domain | EINGSANYEMFIFHNGGVQILCKYPDIVQQFKMQLLKGGQILCDL TKTKGSGNKVSIKSLKFCHSQLSNNSVSFFLYNLDRSHANYYFCN LSIFDPPPFKVTLTGGYLHIYESQLCCQLK |
| 515 | Human ICOS ligand | Amino acid sequence of human ICOS ligand comprising extracellular domain | DTQEKEVRAMVGSDVELSCACPEGSRFDLNDVYVYWQTSESKTVV TYHIPQNSSLENVDSRYRNRALMSPAGMLRGDFSLRLFNVTPQDE QKFHCLVLSQSLGFQEVLSVEVTLHVAANFSVPVVSAPHSPSQDE LTFTCTSINGYPRPNVYWINKTDNSLLDQALQNDTVFLNMRGLYD VVSVLRIARTPSVNIGCCIENVLLQQNLTVGSQTGNDIGERDKIT ENPVSTGEKNAATWS |
| 516 | Human ICOS ligand | Amino acid sequence of human ICOS ligand including signal peptide | MRLGSPGLLFLLFSSLRADTQEKEVRAMVGSDVELSCACPEGSRF DLNDVYVYWQTSESKTVVTYHIPQNSSLENVDSRYRNRALMSPAG MLRGDFSLRLFNVTPQDEQKFHCLVLSQSLGFQEVLSVEVTLHVA ANFSVPVVSAPHSPSQDELTFTCTSINGYPRPNVYWINKTDNSLL DQALQNDTVFLNMRGLYDVVSVLRIARTPSVNIGCCIENVLLQQN LTVGSQTGNDIGERDKITENPVSTGEKNAATWSILAVLCLLVVVA VAIGWVCRDRCLQHSYAGAWAVSPETELTGHV |
| 517 | C-terminal amino acid sequence of hIL-2 | Amino acids 21 to 133 of hIL-2 with R38W mutation (bold & underlined) | LQMILNGINNYKNPKLT<u>A</u>MLTFKFYMPKKATELKHLQCLEEELKP LEEVLNLAQSKNFHLRPRDLISNINVIVLELKGSETTFMCEYADE TATIVEFLNRWITFCQSIISTLT |

TABLE S2-continued

SEQ ID NOS: 343-538

| SEQ ID NO: | Name | Description | Sequence |
|---|---|---|---|
| 518 | C-terminal amino acid sequence of hIL-2 | Amino acids 21 to 133 of hIL-2 with R38Q mutation (bold & underlined) | LQMILNGINNYKNPKLTQMLTFKFYMPKKATELKHLQCLEEELKP LEEVLNLAQSKNFHLRPRDLISNINVIVLELKGSETTFMCEYADE TATIVEFLNRWITFCQSIISTLT |
| 519 | STIM002 - Corrected Light chain variable region | Nucleic acid sequence of corrected V$_L$ of STIM002 | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTATTTGGATTGGTACCTGCAGAAGCCA GGGCAGTCTCCACAGCTCCTGATCTATTTGGGTTCTACTCGGGCC TCCGGGTTCCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGCTCAGTTTTGGCCAG GGGACCAAGCTGGAGATCAAA |
| 520 | STIM002 - Corrected full light chain sequence | Nucleic acid sequence of corrected STIM002 light chain | GATATTGTGATGACTCAGTCTCCACTCTCCCTGCCCGTCACCCCT GGAGAGCCGGCCTCCATCTCCTGCAGGTCTAGTCAGAGCCTCCTG CATAGTGATGGATACAACTATTTGGATTGGTACCTGCAGAAGCCA GGGCAGTCTCCACAGCTCCTGATCTATTTGGGTTCTACTCGGGCC TCCGGGTTCCCTGACAGGTTCAGTGGCAGTGGATCAGGCACAGAT TTTACACTGAAAATCAGCAGAGTGGAGGCTGAGGATGTTGGGGTT TATTACTGCATGCAAGCTCTACAAACTCCGCTCAGTTTTGGCCAG GGGACCAAGCTGGAGATCAAAcgtacggtggccgctcccccgtg ttcatcttcccaccttccgacgagcagctgaagtccggcaccgct tctgtcgtgtgcctgctgaacaacttctaccccccgcgaggccaag gtgcagtggaaggtggacaacgccctgcagtccggcaactcccag gaatccgtgaccgagcaggactccaaggacagcacctactccctg tcctccaccctgaccctgtccaaggccgactacgagaagcacaag gtgtacgcctgcgaagtgacccaccagggcctgtctagccccgtg accaagtctttcaaccggggcgagtgt |
| 521 | STIM003 - Corrected heavy chain variable region | Nucleic acid sequence of corrected V$_H$ of STIM003 | GAGGTGCAGCTGGTGGAGTCTGGGGGAGGTGTGGTACGGCCTGGG GGGTCCCTGAGACTCTCCTGTGTAGCCTCTGGAGTCACCTTTGAT GATTATGGCATGAGCTGGGTCCGCCAAGCTCCAGGGAAGGGGCTG GAGTGGGTCTCTGGTATTAATTGGAATGGTGGCGACACAGATTAT TCAGACTCTGTGAAGGGCCGATTCACCATCTCCAGAGACAACGCC AAGAACTCCCTGTATCTACAAATGAATAGTCTGAGAGCCGAGGAC ACGGCCTTGTATTACTGTGCGAGGGATTTCTATGGTTCGGGGAGT TATTATCACGTTCCTTTTGACTACTGGGGCCAGGGAATCCTGGTC ACCGTCTCCTCA |
| 522 | STIM003 - Corrected full heavy chain sequence | Nucleic acid sequence of corrected STIM003 heavy chain | GAGGTGCAGCTGGTGGAGTCTGGGGGAGGTGTGGTACGGCCTGGG GGGTCCCTGAGACTCTCCTGTGTAGCCTCTGGAGTCACCTTTGAT GATTATGGCATGAGCTGGGTCCGCCAAGCTCCAGGGAAGGGGCTG GAGTGGGTCTCTGGTATTAATTGGAATGGTGGCGACACAGATTAT TCAGACTCTGTGAAGGGCCGATTCACCATCTCCAGAGACAACGCC AAGAACTCCCTGTATCTACAAATGAATAGTCTGAGAGCCGAGGAC ACGGCCTTGTATTACTGTGCGAGGGATTTCTATGGTTCGGGGAGT TATTATCACGTTCCTTTTGACTACTGGGGCCAGGGAATCCTGGTC ACCGTCTCCTCAGCCAGCACCAAGGGCCCCTCTGTGTTCCCTCTG GCCCCTTCCAGCAAGTCCACCTCTGGCGGAACAGCCGCTCTGGGC TGCCTCGTGAAGGACTACTTCCCCGAGCCTGTGACCGTGTCCTGG AACTCTGGCGCTCTGACCAGCGGAGTGCACACCTTCCCTGCTGTG CTGCAGTCCTCCGGCCTGTACTCCCTGTCCTCCGTCGTGACCGTG CCTTCCAGCTCTCTGGGCACCCAGACCTACATCTGCAACGTGAAC CACAAGCCCTCCAACACCAAGGTGGACAAGAAGGTGGAACCCAAG TCCTGCGACAAGACCCACACCTGTCCCCCTTGTCCTGCCCCTGAA CTGCTGGGCGGACCTTCCGTGTTCCTGTTCCCCCCAAAGCCCAAG GACACCCTGATGATCTCCCGGACCCCCGAAGTGACCTGCGTGGTG GTGGATGTGTCCCACGAGGACCCTGAAGTGAAGTTCAATTGGTAC GTGGACGGCGTGGAAGTGCACAACGCCAAGACCAAGCCTAGAGAG GAACAGTACAACTCCACCTACCGGGTGGTGTCCGTGCTGACCGTG CTGCACCAGGATTGGCTGAACGGCAAAGAGTACAAGTGCAAGGTG TCCAACAAGGCCCTGCCTGCCCCCATCGAAAAGACCATCTCCAAG GCCAAGGGCCAGCCCCGGGAACCCCAGGTGTACACACTGCCCCCT AGCAGGGACGAGCTGACCAAGAACCAGGTGTCCCTGACCTGTCTC GTGAAAGGCTTCTACCCCTCCGATATCGCCGTGGAATGGGAGTCC AACGGCCAGCCTGAGAACAACTACAAGACCACCCCCCCTGTGCTG GACTCCGACGGCTCATTCTTCCTGTACAGCAAGCTGACAGTGGAC AAGTCCCGGTGGCAGCAGGGCAACGTGTTCTCCTGCTCCGTGATG CACGAGGCCCTGCACAACCACTACACCCAGAAGTCCCTGTCCCTG AGCCCCGGCAAGTGATGA |

TABLE S2-continued

SEQ ID NOS: 343-538

| SEQ ID NO: | Name | Description | | Sequence |
|---|---|---|---|---|
| 523 | Human IgG1 constant region | IGHG 1*03 | Human Heavy Chain Constant Region (IGHG1*03) Nucleotide Sequence | gcctccaccaagggcccatcggtcttccccctggcaccctcctcc aagagcacctctgggggcacagcggccctgggctgcctggtcaag gactacttccccgaaccggtgacggtgtcgtggaactcaggcgcc ctgaccagcggcgtgcacaccttcccggctgtcctacagtcctca ggactctactccctcagcagcgtggtgaccgtgccctccagcagc ttgggcacccagacctacatctgcaacgtgaatcacaagcccagc aacaccaaggtggacaagagagttgagcccaaatcttgtgacaaa actcacacatgcccaccgtgcccagcacctgaactcctggggggA ccgtcagtcttcctcttccccccaaaacccaaggacaccctcatg atctcccggacccctgaggtcacatgcgtggtggtggacgtgagc cacgaagaccctgaggtcaagttcaactggtacgtggacggcgtg gaggtgcataatgccaagacaaagccgcgggaggagcagtacaac agcacgtaccgtgtggtcagcgtcctcaccgtcctgcaccaggac tggctgaatggcaaggagtacaagtgcaaggtctccaacaaagcc ctcccagcccccatcgagaaaaccatctccaaagccaaagggcag ccccgagaaccacaggtgtacaccctgcccccatcccgggaggag gaccaagaaccaggtcagcctgacctgcctggtcaaaggcttcta tcccagcgacatcgccgtggagtgggagagcaatgggcagccgga gaacaactacaagaccacgcctcccgtgctggactccgacggctc cttcttcctctatagcaagctcaccgtggacaagagcaggtggca gcaggggaacgtcttctcatgctccgtgatgcatgaggctctgca caaccactacacgcagaagagcctctccctgtccccgggtaaa |
| 524 | | | Human Heavy Chain Constant Region (IGHG103) Protein Sequence | A S T K G P S V F P L A P S S K S T S G G T A<br>A L G C L V K D Y F P E P V T V S W N S G A L<br>T S G V H T F P A V L Q S S G L Y S L S S V V<br>T V P S S S L G T Q T Y I C N V N H K P S N T<br>K V D K R V E P K S C D K T H T C P P C P A P<br>E L L G G P S V F L F P P K P K D T L M I S R<br>T P E V T C V V V D V S H E D P E V K F N W Y<br>V D G V E V H N A K T K P R E E Q Y N S T Y R<br>V V S V L T V L H Q D W L N G K E Y K C K V S<br>N K A L P A P I E K T I S K A K G Q P R E P Q<br>V Y T L P P S R E E M T K N Q V S L T C L V K<br>G F Y P S D I A V E W E S N G Q P E N N Y K T<br>T P P V L D S D G S F F L Y S K L T V D K S R<br>W Q Q G N V F S C S V M H E A L H N H Y T Q K<br>S L S L S P G K |
| 525 | Human IgG1 constant region | IGHG 1*04 | Human Heavy Chain Constant Region (IGHG1*04) Nucleotide Sequence | gcctccaccaagggcccatcggtcttccccctggcaccctcctcc aagagcacctctgggggcacagcggccctgggctgcctggtcaag gactacttccccgaaccggtgacggtgtcgtggaactcaggcgcc ctgaccagcggcgtgcacaccttcccggctgtcctacagtcctca ggactctactccctcagcagcgtggtgaccgtgccctccagcagc ttgggcacccagacctacatctgcaacgtgaatcacaagcccagc aacaccaaggtggacaagaaagttgagcccaaatcttgtgacaaa actcacacatgcccaccgtgcccagcacctgaactcctggggggA ccgtcagtcttcctcttccccccaaaacccaaggacaccctcatg atctcccggacccctgaggtcacatgcgtggtggtggacgtgagc cacgaagaccctgaggtcaagttcaactggtacgtggacggcgtg gaggtgcataatgccaagacaaagccgcgggaggagcagtacaac agcacgtaccgtgtggtcagcgtcctcaccgtcctgcaccaggac tggctgaatggcaaggagtacaagtgcaaggtctccaacaaagcc ctcccagcccccatcgagaaaaccatctccaaagccaaagggcag ccccgagaaccacaggtgtacaccctgcccccatcccgggatgag ctgaccaagaaccaggtcagcctgacctgcctggtcaaaggcttc tatcccagcgacatcgccgtggagtgggagagcaatgggcagccg gagaacaactacaagaccacgcctcccgtgctggactccgacggc tccttcttcctctacagcaagctcaccgtggacaagagcaggtgg cagcaggggaacatcttctcatgctccgtgatgcatgaggctctg cacaaccactacacgcagaagagcctctccctgtctccgggtaaa |
| 526 | | | Human Heavy Chain Constant Region (IGHG1*04) Protein Sequence | ASTKGPSVFPLAPSSKSTSGGTAALGCLVKDYFPEPVTVSWNSGA<br>LTSGVHTFPAVLQSSGLYSLSSVVTVPSSSLGTQTYICNVNHKPS<br>NTKVDKKVEPKSCDKTHTCPPCPAPELLGGPSVFLFPPKPKDTLM<br>ISRTPEVTCVVVDVSHEDPEVKFNWYVDGVEVHNAKTKPREEQYN<br>STYRVVSVLTVLHQDWLNGKEYKCKVSNKALPAPIEKTISKAKGQ<br>PREPQVYTLPPSRDELTKNQVSLTCLVKGFYPSDIAVEWESNGQP<br>ENNYKTTPPVLDSDGSFFLYSKLTVDKSRWQQGNIFSCSVMHEAL<br>HNHYTQKSLSLSPGK |
| 527 | Human IgG2 constant | IGHG 2*01 & | Human Heavy Chain Constant Region (IGHG2*01) | gcctccaccaagggcccatcggtcttccccctggcgccctgctcc aggagcacctccgagagcacagccgccctgggctgcctggtcaag gactacttccccgaaccggtgacggtgtcgtggaactcaggcgct |

TABLE S2-continued

SEQ ID NOS: 343-538

| SEQ ID NO: | Name | Description | | Sequence |
|---|---|---|---|---|
| | region | IGHG 2*03 & IGHG 2*05 | Nucleotide Sequence | ctgaccagcggcgtgcacaccttcccagctgtcctacagtcctca ggactctactccctcagcagcgtggtgaccgtgccctccagcaac ttcggcacccagacctacacctgcaacgtagatcacaagcccagc aacaccaaggtggacaagacagttgagcgcaaatgttgtgtcgag tgcccaccgtgcccagcaccacctgtggcaggaccgtcagtcttc ctcttccccccaaaacccaaggacacccctcatgatctcccggacc cctgaggtcacgtgcgtggtggtggacgtgagccacgaagacccc gaggtccagttcaactggtacgtggacggcgtggaggtgcataat gccaagacaaagccacgggaggagcagttcaacagcacgttccgt gtggtcagcgtcctcaccgttgtgcaccaggactggctgaacggc aaggagtacaagtgcaaggtctccaacaaaggcctcccagcccc atcgagaaaaccatctccaaaaccaaagggcagccccgagaacca caggtgtacaccctgcccccatcccgggaggagatgaccaagaac caggtcagcctgacctgcctggtcaaaggcttctaccccagcgac atcgccgtggagtgggagagcaatgggcagccggagaacaactac aagaccacacctcccatgctggactccgacggctccttcttcctc tacagcaagctcaccgtggacaagagcaggtggcagcaggggaac gtcttctcatgctccgtgatgcatgaggctctgcacaaccactac acgcagaagagcctctccctgtctccgggtaaa |
| 528 | | | Human Heavy Chain Constant Region (IGHG2*01) Protein Sequence | ASTKGPSVFPLAPCSRSTSESTAALGCLVKDYFPEPVTVSWNSGA LTSGVHTFPAVLQSSGLYSLSSVVTVPSSNFGTQTYTCNVDHKPS NTKVDKTVERKCCVECPPCPAPPVAGPSVFLFPPKPKDTLMISRT PEVTCVVVDVSHEDPEVQFNWYVDGVEVHNAKTKPREEQFNSTFR VVSVLTVVHQDWLNGKEYKCKVSNKGLPAPIEKTISKTKGQPREP QVYTLPPSREEMTKNQVSLTCLVKGFYPSDIAVEWESNGQPENNY KTTPPMLDSDGSFFLYSKLTVDKSRWQQGNVFSCSVMHEALHNHY TQKSLSLSPGK |
| 529 | Human IgG2 constant region | IGHG 2*02 | Human Heavy Chain Constant Region (IGHG2*02) Nucleotide Sequence | GCCTCCACCAAGGGCCCATCGGTCTTCCCCCTGGCGCCCTGCTCC AGGAGCACCTCCGAGAGCACAGCGGCCCTGGGCTGCCTGGTCAAG GACTACTTCCCCGAACCGGTGACGGTGTCGTGGAACTCAGGCGCT CTGACCAGCGGCGTGCACACCTTCCCGGCTGTCCTACAGTCCTCA GGACTCTACTCCCTCAGCAGCGTGGTGACCGTGACCTCCAGCAAC TTCGGCACCCAGACCTACACCTGCAACGTAGATCACAAGCCCAGC AACACCAAGGTGGACAAGACAGTTGAGCGCAAATGTTGTGTCGAG TGCCCACCGTGCCCAGCACCACCTGTGGCAGGACCGTCAGTCTTC CTCTTCCCCCCAAAACCCAAGGACACCCTCATGATCTCCCGGACC CCTGAGGTCACGTGCGTGGTGGTGGACGTGAGCCACGAAGACCCC GAGGTCCAGTTCAACTGGTACGTGGACGGCGTGGAGGTGCATAAT GCCAAGACAAAGCCACGGGAGGAGCAGTTCAACAGCACGTTCCGT GTGGTCAGCGTCCTCACCGTCGTGCACCAGGACTGGCTGAACGGC AAGGAGTACAAGTGCAAGGTCTCCAACAAAGGCCTCCCAGCCCCC ATCGAGAAAACCATCTCCAAAACCAAAGGGCAGCCCCGAGAACCA CAGGTGTACACCCTGCCCCCATCCCGGGAGGAGATGACCAAGAAC CAGGTCAGCCTGACCTGCCTGGTCAAAGGCTTCTACCCCAGCGAC ATCGCCGTGGAGTGGGAGAGCAATGGGCAGCCGGAGAACAACTAC AAGACCACACCTCCCATGCTGGACTCCGACGGCTCCTTCTTCCTC TACAGCAAGCTCACCGTGGACAAGAGCAGGTGGCAGCAGGGGAAC GTCTTCTCATGCTCCGTGATGCATGAGGCTCTGCACAACCACTAC ACACAGAAGAGCCTCTCCCTGTCTCCGGGTAAA |
| 530 | | | Human Heavy Chain Constant Region (IGHG2*02) Protein Sequence | ASTKGPSVFPLAPCSRSTSESTAALGCLVKDYFPEPVTVSWNSGA LTSGVHTFPAVLQSSGLYSLSSVVTVTSSNFGTQTYTCNVDHKPS NTKVDKTVERKCCVECPPCPAPPVAGPSVFLFPPKPKDTLMISRT PEVTCVVVDVSHEDPEVQFNWYVDGMEVHNAKTKPREEQFNSTFR VVSVLTVVHQDWLNGKEYKCKVSNKGLPAPIEKTISKTKGQPREP QVYTLPPSREEMTKNQVSLTCLVKGFYPSDIAVEWESNGQPENNY KTTPPMLDSDGSFFLYSKLTVDKSRWQQGNVFSCSVMHEALHNHY TQKSLSLSPGK |
| 531 | Human IgG2 constant region | IGHG 2*04 | Human Heavy Chain Constant Region (IGHG2*04) Nucleotide Sequence | gcctccaccaagggcccatcggtcttcccctggcgcctgctcc aggagcacctccgagagcacagcggccctgggctgcctggtcaag gactacttccccgaaccggtgacggtgtcgtggaactcaggcgct ctgaccagcggcgtgcacaccttcccagctgtcctacagtcctca ggactctactccctcagcagcgtggtgaccgtgccctccagcagc ttgggcacccagacctacacctgcaacgtagatcacaagcccagc aacaccaaggtggacaagacagttgagcgcaaatgttgtgtcgag tgcccaccgtgcccagcaccacctgtggcaggaccgtcagtcttc ctcttccccccaaaacccaaggacacccctcatgatctcccggacc cctgaggtcacgtgcgtggtggtggacgtgagccacgaagacccc gaggtccagttcaactggtacgtggacggcgtggaggtgcataat gccaagacaaagccacgggaggagcagttcaacagcacgttccgt gtggtcagcgtcctcaccgttgtgcaccaggactggctgaacggc |

TABLE S2-continued

SEQ ID NOS: 343-538

| SEQ ID NO: | Name | | Description | Sequence |
|---|---|---|---|---|
| | | | | aaggagtacaagtgcaaggtctccaacaaaggcctcccagccccc<br>atcgagaaaccatctccaaaaccaaagggcagccccgagaacca<br>caggtgtacaccctgccccatcccgggaggagatgaccaagaac<br>caggtcagcctgacctgcctggtcaaaggcttctaccccagcgac<br>atcgccgtggagtgggagagcaatgggcagccggagaacaactac<br>aagaccacacctcccatgctggactccgacggctccttcttcctc<br>tacagcaagctcaccgtggacaagagcaggtggcagcaggggaac<br>gtcttctcatgctccgtgatgcatgaggctctgcacaaccactac<br>acgcagaagagcctctccctgtctccgggtaaa |
| 532 | | | Human Heavy Chain Constant Region (IGHG2*04) Protein Sequence | ASTKGPSVFPLAPCSRSTSESTAALGCLVKDYFPEPVTVSWNSGA<br>LTSGVHTFPAVLQSSGLYSLSSVVTVPSSSLGTQTYTCNVDHKPS<br>NTKVDKTVERKCCVECPPCPAPPVAGPSVFLFPPKPKDTLMISRT<br>PEVTCVVVDVSHEDPEVQFNWYVDGVEVHNAKTKPREEQFNSTFR<br>VVSVLTVVHQDWLNGKEYKCKVSNKGLPAPIEKTISKTKGQPREP<br>QVYTLPPSREEMTKNQVSLTCLVKGFYPSDIAVEWESNGQPENNY<br>KTTPPMLDSDGSFFLYSKLTVDKSRWQQGNVFSCSVMHEALHNHY<br>TQKSLSLSPGK |
| 533 | Human IgG2 constant region | IGHG2*06 | Human Heavy Chain Constant Region (IGHG206) Nucleotide Sequence | GCCTCCACCAAGGGCCCATCGGTCTTCCCCCTGGCGCCCTGCTCC<br>AGGAGCACCTCCGAGAGCACAGCGGCCCTGGGCTGCCTGGTCAAG<br>GACTACTTCCCCGAACCGGTGACGGTGTCGTGGAACTCAGGCGCT<br>CTGACCAGCGGCGTGCACACCTTCCCGGCTGTCCTACAGTCCTCA<br>GGACTCTACTCCCTCAGCAGCGTGGTGACCGTGCCCTCCAGCAAC<br>TTCGGCACCCAGACCTACACCTGCAACGTAGATCACAAGCCCAGC<br>AACACCAAGGTGGACAAGACAGTTGAGCGCAAATGTTGTGTCGAG<br>TGCCCACCGTGCCCAGCACCACCTGTGGCAGGACCGTCAGTCTTC<br>CTCTTCCCCCCAAAACCCAAGGACACCCTCATGATCTCCCGGACC<br>CCTGAGGTCACGTGCGTGGTGGTGGACGTGAGCCACGAAGACCCC<br>GAGGTCCAGTTCAACTGGTACGTGGACGGCGTGGAGGTGCATAAT<br>GCCAAGACAAAGCCACGGGAGGAGCAGTTCAACAGCACGTTCCGT<br>GTGGTCAGCGTCCTCACCGTCGTGCACCAGGACTGGCTGAACGGC<br>AAGGAGTACAAGTGCAAGGTCTCCAACAAAGGCCTCCCAGCCCCC<br>ATCGAGAAAACCATCTCCAAAACCAAAGGGCAGCCCCGAGAACCA<br>CAGGTGTACACCCTGCCCCCATCCCGGGAGGAGATGACCAAGAAC<br>CAGGTCAGCCTGACCTGCCTGGTCAAAGGCTTCTACCCCAGCGAC<br>ATCTCCGTGGAGTGGGAGAGCAATGGGCAGCCGGAGAACAACTAC<br>AAGACCACACCTCCCATGCTGGACTCCGACGGCTCCTTCTTCCTC<br>TACAGCAAGCTCACCGTGGACAAGAGCAGGTGGCAGCAGGGGAAC<br>GTCTTCTCATGCTCCGTGATGCATGAGGCTCTGCACAACCACTAC<br>ACACAGAAGAGCCTCTCCCTGTCTCCGGGTAAA |
| 534 | | | Human Heavy Chain Constant Region (IGHG2*06) Protein Sequence | ASTKGPSVFPLAPCSRSTSESTAALGCLVKDYFPEPVTVSWNSGA<br>LTSGVHTFPAVLQSSNFGTQTYTCNVDHKPS<br>NTKVDKTVERKCCVECPPCPAPPVAGPSVFLFPPKPKDTLMISRT<br>PEVTCVVVDVSHEDPEVQFNWYVDGVEVHNAKTKPREEQFNSTFR<br>VVSVLTVVHQDWLNGKEYKCKVSNKGLPAPIEKTISKTKGQPREP<br>QVYTLPPSREEMTKNQVSLTCLVKGFYPSDISVEWESNGQPENNY<br>KTTPPMLDSDGSFFLYSKLTVDKSRWQQGNVFSCSVMHEALRNHY<br>TQKSLSLSPGK |
| 535 | Human Cλ constant region | IGLC7*03 | Cλ Light Chain Constant Region (IGLC7*03) Nucleotide Sequence | GGTCAGCCCAAGGCTGCCCCCTCGGTCACTCTGTTCCCACCCTCC<br>TCTGAGGAGCTTCAAGCCAACAAGGCCACACTGGTGTGTCTCGTA<br>AGTGACTTCAACCCGGGAGCCGTGACAGTGGCCTGGAAGGCAGAT<br>GGCAGCCCCGTCAAGGTGGGAGTGGAGACCACCAAACCCTCCAAA<br>CAAAGCAACAACAAGTATGCGGCCAGCAGCTACCTGAGCCTGACG<br>CCCGAGCAGTGGAAGTCCCACAGAAGCTACAGCTGCCGGGTCACG<br>CATGAAGGGAGCACCGTGGAGAAGACAGTGGCCCCTGCAGAATGC<br>TCT |
| 536 | | | Cλ Light Chain Constant Region (IGLC7*03) Amino Acid Sequence | GQPKAAPSVTLFPPSSEELQANKATLVCLVSDFNPGAVTVAWKAD<br>GSPVKVGVETTKPSKQSNNKYAASSYLSLTPEQWKSHRSYSCRVT<br>HEGSTVEKTVAPAECS |
| 537 | Human WT IgG1 constant region | IGHG1*01 & IGHG1*05 (IgG1) | WT human IgG1 nucleotide sequence #2 | gcctccaccaagggcccatcggtcttccccctggcaccctcctcc<br>aagagcacctctgggggcacagcggccctgggctgcctggtcaag<br>gactacttccccgaaccggtgacggtgtcgtggaactcaggcgcc<br>ctgaccagcggcgtgcacaccttcccggctgtcctacagtcctca<br>ggactctactccctcagcagcgtggtgaccgtgccctccagcagcttgggca<br>cccagacctacatctgcaacgtgaatcacaagcccagcaacacca<br>aggtggacaagaaagttgagcccaaatcttgtgacaaaactcaca<br>catgcccaccgtgcccagcacctgaactcctggggggaccgtcag |

TABLE S2-continued

SEQ ID NOS: 343-538

| SEQ ID NO: Name | Description | | Sequence |
|---|---|---|---|
| | | | tcttcctcttccccccaaaacccaaggacaccctcatgatctccc
ggacccctgaggtcacatgcgtggtggtggacgtgagccacgaag
accctgaggtcaagttcaactggtacgtggacggcgtggaggtgc
ataatgccaagacaaagccgcgggaggagcagtacaacagcacgt
accgggtggtcagcgtcctcaccgtcctgcaccaggactggctga
atggcaaggagtacaagtgcaaggtctccaacaaagccctcccag
cccccatcgagaaaaccatctccaaagccaaagggcagccccgag
aaccacaggtgtacaccctgcccccatcccgggatgagctgacca
agaaccaggtcagcctgacctgcctggtcaaaggcttctatccca
gcgacatcgccgtggagtgggagagcaatgggcagccggagaaca
actacaagaccacgcctcccgtgctggactccgacggctccttct
tcctctacagcaagctcaccgtggacaagagcaggtggcagcagg
ggaacgtcttctcatgctccgtgatgcatgaggctctgcacaacc
actacacgcagaagagcctctccctgtctccgggtaaa |
| 538 Human Cλ constant region | IGLC 2*01 | Cλ Light Chain Constant Region Amino Acid Sequence #2 - Encoded by nucleotide sequence version A & B | GQPKAAPSVTLFPPSSEELQANKATLVCLISDFYPGAVVAWKADT
SSPVKAGVETTTPKSQSNNKYAASSYLSLTPEQWKSHRSYSCQVT
HEGSTVEKTVAPTECS |

TABLE S3

SEQ ID NOS: 539-562

Sequence hIgG1 FIT-Ig bispecific 1a

| Antibody A | anti-ICOS STIM003 | |
|---|---|---|
| Antibody B | anti-PD-L1 84G09 | |
| FIT-Ig Construct #1 | SEQ ID NO: 539 | DIQMTQSPASLSASLGETVTIQCRASEDIYSGLAWFQQKPGKSPQLLIYGASS
LQDGVPSRFSGSGSGTQYSLKISSMQTEDEGVYFCQQGLKYPPTFGSGTKLEI
KRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRG
ECEVQLVESGGGLTQPGKSLKLSCEASGFTFSSFTMHWVRQSPGKGLEWVAFI
RSGSGIVFYADAVRGRFTISRDNAKNLLFLQMNDLKSEDTAMYYCARRPLGHN
TEDSWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWL
NGKEYKCKVSNKALPAPIEKTISKAKGQPREPQVYTLPPSRDELTKNQVSLTC
LVKGFYPSDIAVEWESNGQPENNYKTTPPVLDSDGSFELYSKLTVDKSRWQQG
NVFSCSVMHEALHNHYTQKSLSLSPGK |
| FIT-Ig Construct #2 | SEQ ID NO: 540 | EVQLVESGGGLVQPGRSLKLSCAASGFTFSDFYMAWVRQAPKKGLEWVASISY
EGSSTYYGDSVMGRFTISRDNAKSTLYLQMNSLRSEDTATYYCARQREANWED
WGQGVMVTVSSASTKGPSVFPLAPSSKSTSGGTAALGCLVKDYFPEPVTVSWN
SGALTSGVHTFPAVLQSSGLYSLSSVVTVPSSSLGTQTYICNVNHKPSNTKVD
KKV |
| FIT-Ig Construct #3 | SEQ ID NO: 541 | DIVMTQSPSSLAVSPGEKVTMTCKSSQSLYYSGVKENLLAWYQQKPGQSPKLL
IYYASIRFTGVPDRFTGSGSGTDYTLTITSVQAEDMGQYFCQQGINNPLTEGD
GTKLEIKRTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVT
KSFNRGEC | hIgG1 FIT-Ig bispecific 1b

| Antibody A | anti-PD-L1 84G09 | |
|---|---|---|
| Antibody B | anti-ICOS STIM003 | |
| FIT-Ig Construct #1 | SEQ ID NO: 542 | DIVMTQSPSSLAVSPGEKVTMTCKSSQSLYYSGVKENLLAWYQQKPGQSPKLL
IYYASIRFTGVPDRFTGSGSGTDYTLTITSVQAEDMGQYFCQQGINNPLTFGD
GTKLEIKRTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVT
KSFNRGECEVQLVESGGGLVQPGRSLKLSCAASGFTFSDFYMAWVRQAPKKGL |

TABLE S3-continued

SEQ ID NOS: 539-562

| | | Sequence |
|---|---|---|
| | | EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPCPAPELLGGPSVFLFPPKPKDTLMISRTP EVTCVVVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQV SLTCLVKGFYPSDIAVEWESNGQPENNYKTTPPVLDSDGSFFLYSKLTVDKSR WQQGNVFSCSVMHEALHNHYTQKSLSLSPGK |
| FIT-Ig Construct #2 | SEQ ID NO: 543 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 544 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG EC | hIgG1 FIT-Ig bispecific 2a

| Antibody A | anti-ICOS STIM001 | |
|---|---|---|
| Antibody B | anti-PD-L1 1D05 | |
| FIT-Ig Construct #1 | SEQ ID NO: 545 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTDAAPTVSIFPPSSEQLTSGGASVVCFLNNEYPKDINVKWKIDGSERQNGV LNSWTDQDSKDSTYSMSSTLTLTKDEYERHNSYTCEATHKTSTSPIVKSFNRN ECEVQLVESGGGLTQPGKSLKLSCEASGFTFSSFTMHWVRQSPGKGLEWVAFI RSGSGIVFYADAVRGRFTISRDNAKNLLFLQMNDLKSEDTAMYYCARRPLGHN TFDSWGQGTLVTVSSAKTTAPSVYPLAPVCGDTTGSSVTLGCLVKGYFPEPVT LTWNSGSLSSGVHTFPAVLQSDLYTLSSSVTVTSSTWPSQSITCNVAHPASST KVDKKIEPRGPTIKPCPPCKCPAPNLLGGPSVFIFPPFKIDVLMISLSPIVTC VVVDVSEDDPDVQISWFVNNVEVHTAQTQTHREDYNSTLRVVSALPIQHQDWM SGKEEKCKVNNKDLPAPIERTISKPKGSVRAPQVYVLPPPEEEMTKKQVTLTC MVTDFMPEDIYVEWTNNGKTELNYKNTEPVLDSDGSYFMYSKLRVEKKNWVER NSYSCSVVHEGLHNHHTTKSFSRTPGK |
| FIT-Ig Construct #2 | SEQ ID NO: 546 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSAKTTAPSVYPLAPVCGDTTGSSVTLGCLVKGYFPEPVTLTWN SGSLSSGVHTFPAVLQSDLYTLSSSVTVTSSTWPSQSITCNVAHPASSTKVDK KI |
| FIT-Ig Construct #3 | SEQ ID NO: 547 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTDAAPTVSIFPPSSEQLTSGGASVVCFLNNFYPKDINVKWKIDGS ERQNGVLNSWTDQDSKDSTYSMSSTLTLTKDEYERHNSYTCEATHKTSTSPIV KSFNRNEC | hIgG1 FIT-Ig bispecific 2b

| Antibody A | anti-PD-L1 1D05 | |
|---|---|---|
| Antibody B | anti-ICOS STIM001 | |
| FIT-Ig Construct #1 | SEQ ID NO: 548 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTDAAPTVSIFPPSSEQLTSGGASVVCFLNNFYPKDINVKWKIDGS ERQNGVLNSWTDQDSKDSTYSMSSTLTLTKDEYERHNSYTCEATHKTSTSPIV KSFNRNECEVQLVESGGGLVQPGRSLKLSCAASGFTFSDFYMAWVRQAPKKGL EWVASISYEGSSTYYGDSVMGRFTISRDNAKSTLYLQMNSLRSEDTATYYCAR QREANWEDWGQGVMVTVSSAKTTAPSVYPLAPVCGDTTGSSVTLGCLVKGYFP EPVTLTWNSGSLSSGVHTFPAVLQSDLYTLSSSVTVTSSTWPSQSITCNVAHP ASSTKVDKKIEPRGPTIKPCPPCKCPAPNLLGGPSVFIFPPKIKDVLMISLSP IVTCVVVDVSEDDPDVQISWFVNNVEVHTAQTQTHREDYNSTLRVVSALPIQH QDWMSGKEFKCKVNNKDLPAPIERTISKPKGSVRAPQVYVLPPPEEEMTKKQV TLTCMVTDFMPEDIYVEWTNNGKTELNYKNTEPVLDSDGSYFMYSKLRVEKKN WVERNSYSCSVVHEGLHNHHTTKSFSRTPGK |
| FIT-Ig Construct #2 | SEQ ID NO: 549 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSAKTTAPSVYPLAPVCGDTTGSSVTLGCLVKGYFPEPVTLT WNSGSLSSGVHTFPAVLQSDLYTLSSSVTVTSSTWPSQSITCNVAHPASSTKV DKKI |
| FIT-Ig Construct #3 | SEQ ID NO: 550 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTDAAPTVSIFPPSSEQLTSGGASVVCFLNNFYPKDINVKWKIDGSERQNGV |

TABLE S3-continued

SEQ ID NOS: 539-562

| | | Sequence |
|---|---|---|
| | | LNSWTDQDSKDSTYSMSSTLTLTKDEYERHNSYTCEATHKTSTSPIVKSFNRN EC | hIgG1 FIT-Ig bispecific 3a

| | | |
|---|---|---|
| Antibody A | anti-ICOS STIM003 | |
| Antibody B | anti-PD-L1 1D05 | |
| FIT-Ig Construct #1 | SEQ ID NO: 551 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG ECEVQLVESGGGLTQPGKSLKLSCEASGFTFSSFTMHWVRQSPGKGLEWVAFI RSGSGIVFYADAVRGRFTISRDNAKNLLFLQMNDLKSEDTAMYYCARRPLGHN TFDSWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPSN TKVDKKVEPKSCDKTHTCPPNLLGGPSVFIFPPKIKDVLMISLSPIVTCVVVD VSEDDPDVQISWFVNNVEVHTAQTQTHREDYNSTLRVVSALPIQHQDWMSGKE FKCKVNNKDLPAPIERTISKPKGSVRAPQVYVLPPPEEEMTKKQVTLTCMVTD EMPEDIYVEWTNNGKTELNYKNTEPVLDSDGSYFMYSKLRVEKKNWVERNSYS CSVVHEGLHNHHTTKSFSRTPGK |
| FIT-Ig Construct #2 | SEQ ID NO: 552 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVD KKV |
| FIT-Ig Construct #3 | SEQ ID NO: 55 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGEC | hIgG1 FIT-Ig bispecific 3b

| | | |
|---|---|---|
| Antibody A | anti-PD-L1 1D05 | |
| Antibody B | anti-ICOS STIM003 | |
| FIT-Ig Construct #1 | SEQ ID NO: 554 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSENRGECEVQLVESGGGLVQPGRSLKLSCAASGFTESDFYMAWVRQAPKKGL EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPNLLGGPSVFIFPPKIKDVLMISLSPIVTC VVVDVSEDDPDVQISWFVNNVEVHTAQTQTHREDYNSTLRVVSALPIQHQDWM SGKEFKCKVNNKDLPAPIERTISKPKGSVRAPQVYVLPPPEEEMTKKQVTLTC MVTDEMPEDIYVEWTNNGKTELNYKNTEPVLDSDGSYFMYSKLRVEKKNWVER NSYSCSVVHEGLHNHHTTKSFSRTPGK |
| FIT-Ig Construct #2 | SEQ ID NO: 555 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 556 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTEGSGTKLEI KRTVAAPSVFIFPPSDEQLKSGTASVVCLLNNEYPREAKVQWKVDNALQSGNS QESVTEQDSKDSTYSLSSTLTLSKADYEKHKVYACEVTHQGLSSPVTKSFNRG EC | hIgG1 FIT-Ig bispecific 4a

| | | |
|---|---|---|
| Antibody A | anti-ICOS STIM001 | |
| Antibody B | anti-PD-L1 84G09 | |
| FIT-Ig Construct #1 | SEQ ID NO: 557 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG ECEVQLVESGGGLTQPGKSLKLSCEASGFTFSSFTMHWVRQSPGKGLEWVAFI RSGSGIVFYADAVRGRFTISRDNAKNLLFLQMNDLKSEDTAMYYCARRPLGHN TFDSWGQGTLVTVSSASTKGPSVFPLAPSSKSTSGGTAALGCLVKDYFPEPVT |

TABLE S3-continued

SEQ ID NOS: 539-562

| | | Sequence |
|---|---|---|
| | | VSWNSGALTSGVHTFPAVLQSSGLYSLSSVVTVPSSSLGTQTYICNVNHKPSN TKVDKKVEPKSCDKTHTCPPNLLGGPSVFIFPPKIKDVLMISLSPIVTCVVVD VSEDDPDVQISWFVNNVEVHTAQTQTHREDYNSTLRVVSALPIQHQDWMSGKE FKCKVNNKDLPAPIERTISKPKGSVRAPQVYVLPPPEEEMTKKQVTLTCMVTD FMPEDIYVEWTNNGKTELNYKNTEPVLDSDGSYFMYSKLRVEKKNWVERNSYS CSVVHEGLHNHHTTKSFSRTPGK |
| FIT-Ig Construct #2 | SEQ ID NO: 558 | EVQLVESGGGLVQPGRSLKLSCAASGFTFSDFYMAWVRQAPKKGLEWVASISY EGSSTYYGDSVMGRFTISRDNAKSTLYLQMNSLRSEDTATYYCARQREANWED WGQGVMVTVSSASTKGPSVFPLAPSSKSTSGGTAALGCLVKDYFPEPVTVSWN SGALTSGVHTFPAVLQSSGLYSLSSVVTVPSSSLGTQTYICNVNHKPSNTKVD KKV |
| FIT-Ig Construct #3 | SEQ ID NO: 559 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNRGEC | hIgG1 FIT-Ig bispecific 4b

| Antibody A | anti-PD-L1 84G09 | |
|---|---|---|
| Antibody B | anti-ICOS STIM001 | |
| FIT-Ig Construct #1 | SEQ ID NO: 560 | DIVMTQSPSSLAVSPGEKVTMTCKSSQSLYYSGVKENLLAWYQQKPGQSPKLL IYYASIRFTGVPDRFTGSGSGTDYTLTITSVQAEDMGQYFCQQGINNPLTFGD GTKLEIKRTVAAPSVFIFPPSDEQLKSGTASVVCLLNNFYPREAKVQWKVDNA LQSGNSQESVTEQDSKDSTYSLSSTLTLSKADYEKHKVYACEVTHQGLSSPVT KSFNAGECEVQLVESGGGLVQPGRSLKLSCAASGFTFSDFYMAWVRQAPKKGL EWVASISYEGSSTYYGDSVMGRFTISRDNAKSTLYLQMNSLRSEDTATYYCAR QREANWEDWGQGVMVTVSSASTKGPSVFPLAPSSKSTSGGTAALGCLVKDYFP EPVTVSWNSGALTSGVHTFPAVLQSSGLYSLSSVVTVPSSSLGTQTYICNVNH KPSNTKVDKKVEPKSCDKTHTCPPNLLGGPSVFIFPPKIKDVLMISLSPIVTC VVVDVSEDDPDVQISWFVNNVEVHTAQTQTHREDYNSTLRVVSALPIQHQDWM SGKEFKCKVNNKDLPAPIERTISKPKGSVRAPQVYVLPPPEEEMTKKQVTLTC MVTDFMPEDIYVEWTNNGKTELNYKNTEPVLDSDGSYFMYSKLRVEKKNWVER NSYSCSVVHEGLHNHHTTKSFSRTPGK |
| FIT-Ig Construct #2 | SEQ ID NO: 561 | EVQLVESGGGLTQPGKSLKLSCEASGFTFSSFTMHWVRQSPGKGLEWVAFIRS GSGIVFYADAVRGRFTISRDNAKNLLFLQMNDLKSEDTAMYYCARRPLGHNTF DSWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTK VDKKV |
| FIT-Ig Construct #3 | SEQ ID NO: 562 | DIQMTQSPASLSASLGETVTIQCRASEDIYSGLAWFQQKPGKSPQLLIYGASS LQDGVPSRFSGSGSGTQYSLKISSMQTEDEGVYFCQQGLKYPPTFGSGTKLEI KRTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNRG EC | motif $X_1GSGX_2YGX_3X_4FD$ (SEQ ID NO: 609)

SEQ ID NO: E10 ICOSL-Fc
DTQEKEVRAMVGSDVELSCACPEGSSPEGSDVELSCACPEGSSFRDLNDVYVYWQTSESKTVVTYHIPQNSSLENVDSRYRNRALMSPAGMLRGDFSL
RLFNVTPQDEQKFHCLVLSQSLGFQEVLSVEVTLHVAANFSVPVVSAPHSPSQDELTFTCTSINGYPRPNVYWINKTDNS
LLDQALQNDTVFLNMRGLYDVVSVLRIARTPSVNIGCCIENVLLQQNLTVGSQTGNDIGERDKITENPVSTGEKNAATWS
DIEGRMDPKSCDKTHTCPPCPAPELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQVYTLPPSRDELTKNQVSLTCLV
KGFYPSDIAVEWESNGQPENNYKTTPPVLDSDGSFFLYSKLTVDKSRWQQGNVFSCSVMHEALHNHYTQKSLSLSPGK
Linker is underlined and in bold. Sequence preceding linker is human ICOSL
(B7-H2). Sequence following linker is human IgG1 Fc.

TABLE S4

Sequences of anti-ICOS antibody heavy chain variable regions
obtained from additional clones
CDRs are defined according to IMGT.

| CLONE_ID | VH_NUCLEOTIDE SEQUENCE | VH_AMINO_ ACID_SEQ | HCDR1 | HCDR2 | HCDR3 |
|---|---|---|---|---|---|
| CL-61091 | CAGGTTCAACTGATGCAGTCTGGAACT GAGGTGAAGAAGCCTGGGGCCTCAGTG AAGGTCTCCTGCAAGACTTCTGGTTAC ACCTTTACCACCTATGGTATCACTTGG GTGCGACAGGCCCCTGGACAAGGGCTT | QVQLMQSGTE VKKPGASVKV SCKTSGYTFT TYGITWVRQA PGQGLEWMGW | GYTFT TYG SEQ ID NO: | ISAYS GDT SEQ ID NO: | ARSSGWPH HYGMDV SEQ ID NO: 567 |

TABLE S4-continued

Sequences of anti-ICOS antibody heavy chain variable regions obtained from additional clones
CDRs are defined according to IMGT.

| CLONE_ID | VH_NUCLEOTIDE SEQUENCE | VH_AMINO_ACID_SEQ | HCDR1 | HCDR2 | HCDR3 |
|---|---|---|---|---|---|
| | GAGTGGATGGGATGGATCAGCGCTTAC AGTGGTGACACAGACTATGCACAGAAG TTCCAGGGCAGAGTCACCGTGACAACA GACACATCCACGAACACAGCCTACATG GAGTTGAGGAGCCTGAAATCTGACGAC ACGGCCGTGTATTATTGTGCGAGAAGT AGTGGCTGGCCCCACCACTACGGTATG GACGTCTGGGGCCAAGGGACCACGGTC ACCGTCTCCTCAG SEQ ID NO: 563 | ISAYSGDTDY AQKFQGRVTV TTDTSTNTAY MELRSLKSDD TAVYYCARSS GWPHHYGMDV WGQGTTVTVS S SEQ ID NO: 564 | 565 | 566 | |
| CL-64536 | CAGGTTCAACTGGTGCAGTCTGGAGGT GAGGTGAAAAAGCCTGGGGCCTCAGTG AAGGTCTCCTGCAAGGCTTCTGGTTAC ACCTTTACCAGCTATGGTTTCAGCTGG GTGCGACAGGCCCCTGGACAAGGACTA GAGTGGATGGGATGGATCAGCGCTTAC AATGGTAACACAAACTATGCACAGAAG CTCCAGGGCAGAGTCTCCATGACCACA GACACATCCACGAGCACAGCCTACATG GAGCTGAGGAGCTTGAGATCTGACGAC ACGGCCGTGTATTTCTGTGCGCGATCT ACGTCTTACTATGGTTCGGGGACCCTA TACGGTATGGACGTCTGGGGCCAAGGG ACCACGGTCACCGTCTCCTCAG SEQ ID NO: 568 | QVQLVQSGGE VKKPGASVKV SCKASGYTFT SYGFSWVRQA PGQGLEWMGW ISAYNGNTNY AQKLQGRVSM TTDTSTSTAY MELRSLRSDD TAVYFCARST SYYGSGTLYG MDVWGQGTTV TVSS SEQ ID NO: 569 | GYTFT SYG SEQ ID NO: 377 | ISAYN GNT SEQ ID NO: 378 | ARSTSYYG SGTLYGMD V SEQ ID NO: 570 |
| CL-64837 | CAGGTTCAACTGGTGCAGTCTGGAGGT GAGGTGAAGAAGCCTGGGGCCTCAGTG AAGGTCTCCTGCAAGGCTTCTGGTTAC ACCTTTACCAGCTATGGTTTCAGCTGG GTGCGACAGGCCCCTGGACAAGGACTA GAGTGGATGGGATGGATCAGCGCTTAC AATGGTAACACAAACTATGCACAGAAG CTCCAGGGCAGAGTCTCCATGACCACA GACACATCCACGAGCACAGCCTACATG GAGCTGAGGAGCTTGAGATCTGACGAC ACGGCCGTGTATTACTGTGCGCGATCT ACGTCTTACTATGGTTCGGGGACCCTC TACGGTATGGACGTCTGGGGCCAAGGG ACCACGGTCACCGTCTCCTCAG SEQ ID NO: 571 | QVQLVQSGGE VKKPGASVKV SCKASGYTFT SYGFSWVRQA PGQGLEWMGW ISAYNGNTNY AQKLQGRVSM TTDTSTSTAY MELRSLRSDD TAVYYCARST SYYGSGTLYG MDVWGQGTTV TVSS SEQ ID NO: 572 | GYTFT SYG SEQ ID NO: 377 | ISAYN GNT SEQ ID NO: 378 | ARSTSYYG SGTLYGMD V SEQ ID NO: 570 |
| CL-64841 | CAGGTTCAACTGGTGCAGTCTGGAGGT GAGGTGAAAAAGCCTGGGGCCTCAGTG AAGGTCTCCTGCAAGGCTTCTGGTTAC ACCTTTACCAGCTATGGTTTCAGCTGG GTGCGACAGGCCCCTGGACAAGGACTA GAGTGGATGGGATGGATCAGCGCTTAC AATGGTAACACAAACTATGCACAGAAG CTCCAGGGCAGAGTCTCCATGACCACA GACACATCCACGAGCACAGCCTACATG GAGCTGAGGAGCTTGAGATCTGACGAC ACGGCCGTGTATTTCTGTGCGCGATCT ACGTCTTACTATGGTTCGGGGACCCTA TACGGTATGGACGTCTGGGGCCAAGGG ACCACGGTCACCGTCTCCTCAG SEQ ID NC: 573 | QVQLVQSGGE VKKPGASVKV SCKASGYTFT SYGFSWVRQA PGQGLEWMGW ISAYNGNTNY AQKLQGRVSM TTDTSTSTAY MELRSLRSDD TAVYFCARST SYYGSGTLYG MDVWGQGTTV TVSS SEQ ID NO: 574 | GYTFT SYG SEQ ID NO: 377 | ISAYN GNT SEQ ID NO: 378 | ARSTSYYG SGTLYGMD V SEQ ID NO: 570 |
| CL-64912 | CAGGTTCAACTGGTGCAGTCTGGAGGT GAGGTGAAAAAGCCTCGGGCCTCAGTG AAGGTCTCCTGCAAGGCTTCTGGTTAC ACCTTTACCAGCTATGTGTTCAGCTGG GTGCGACATGCCGCTGGACAAGGACTA GAGTGGATGGGATGGATCAGCGGTTAC AATGGTAACACAAACTATGCACAGAAG CTCCAGTGCGGAGTCTCGATGACCGCA GACACATCCACGAGCACAGCCTACATG GAGCTGAGGAGCTTGAGATCTGACGAC ACGGCCGTGTATTTCTGTGCGCGATCT ACGTCTTACTATGGTGCGGGGACCCTA TACGGTATGGACGTCTGGGGCCAAGGG ACCACGGTCACCGTCTCCTCAG SEQ ID NO: 575 | QVQLVQSGGE VKKPRASVKV SCKASGYTFT SYVFSWVRHA AGQGLEWMGW ISGYNGNTNY AQKLQCGVSM TADTSTSTAY MELRSLRSDD TAVYFCARST SYYGAGTLYG MDVWGQGTTV TVSS SEQ ID NO: 576 | GYTFT SYV SEQ ID NO: 577 | ISGYN GNT SEQ ID NO: 578 | ARSTSYYG AGTLYGMD V SEQ ID NO: 579 |

TABLE S4-continued

Sequences of anti-ICOS antibody heavy chain variable regions obtained from additional clones
CDRs are defined according to IMGT.

| CLONE_ID | VH_NUCLEOTIDE SEQUENCE | VH_AMINO_ACID_SEQ | HCDR1 | HCDR2 | HCDR3 |
|---|---|---|---|---|---|
| CL-71642 | GAGGTGCAGCTGGTGGAGTCTGGGGGA GGTGTGGTACGGCCTGGGGGGTCCCTG AGACTCTCCTGTGCAGCCTCTGGATTC ACCTTTGATGATTATGGCATGAGCTGG GTCCGCCAAGCTCCAGGGAAGGGGCTG GAGTGGGTCTCTGGTATTAATTGGAAT GGTGGTAGCACAGGTTATGCAGACTCT GTGAAGGGCCGATTCACCATCTCCAGA GACAACGCCAAGAACTCCCTGTATCTG CAAATGAACAGTCTGAGAGCCGAGGAC ACGGCCTTGTATTACTGTGCGGCCGAT TACTATGGTTCGGGGAG7TATTATAAC TGTCCCCTTTGACTACTGGGGCCAGGGA ACCCTGGTCACCGTCTCCTCAG SEQ ID NO: 580 | EVQLVESGGG VVRPGGSLRL SCAASGFTFD DYGMSWVRQA PGKGLEWVSG INWNGGSTGY ADSVKGRFTI SRDNAKNSLY LQMNSLRAED TALYYCAADY YGSGSYYNVP FDYWGQGTLV TVSS SEQ ID NO: 581 | GFTFD DYG SEQ ID NO: 582 | INWNG GST SEQ ID NO: 583 | AADYYGSG SYYNVPFD Y SEQ ID NO: 584 |
| CL-74570 | GAGGTGCAGCTGGTGGAGTCTGGGGGA GGTGTGATACGGCCTGGGGGGTCCCTG AGACTCTCCTGTGCAGCCTCTGGATTC ACCTTTGATGATTATGGCATGAGCTGG GTCCGCCAAGCTCCAGGGAAGGGGCTG GAGTGGGTCTCTGGTATTAATTGGATT GGTGATAACACAGATTATGCAGACTCT GTGAAGGGCCGATTCACCATCTCCAGA GACAACGCCAAGAACTCCCTATATCTG CAAATGAACAGTCTGAGAGCCGAGGAC ACGGCCTTGTATTACTGTGCGAGAGAT TACTTTGGTTCGGGGAGTTATTATAAC TGTTCCCTTTGACTACTGGGGCCAGGGA ACCCTGGTCACCGTCTCCTCAG SEQ ID NO: 585 | EVQLVESGGG VIRPGGSLRL SCAASGFTFD DYGMSWVRQA PGKGLEWVSG INWIGDNTDY ADSVKGRFTI SRDNAKNSLY LQMNSLRAED TALYYCARDY FGSGSYYNVP FDYWGQGTLV TVSS SEQ ID NO: 586 | GFTFD DYG SEQ ID NO: 582 | INWIG DNT SEQ ID NO: 587 | ARDYFGSG SYYNVPFD Y SEQ ID NO: 588 |

TABLE S5

Sequences of anti-ICOS antibody light chain variable regions obtained from additional clones
N terminal E and 5' nucleotide additions in CL-71642 are shown in bold. These were not recovered in sequencing but were determined to be present in the sequence by comparison against related clones. CDRs are defined according to IMGT.

| CLONE_ID | VL_NUCLEOTIDE_SEQUENCE | VL_AMINO_ACID_SEQ | LCDR1 | LCDR2 | LCDR3 |
|---|---|---|---|---|---|
| CL-61091 | GATATTGTGATGACTCAGTCTCCACTC TCCCTGCCCGTCACCCCTGGAGAGCCG GCCTCCATCTCCTGCAGGTCTAGTCAG AGCCTCCTGCATAGTAATGGATTCAAC TATTTCGATTGGTACCTGCAGAAGCCA GGACAGTCTCCACAGCTCCTGATCTTT TTGGTTTCTAATCGGGCCTCCGGGGTC CCTGACAGGTTCAGTGGCAGTGGATCA GGCACAGATTTTACACTGAAAATCAGC AGAGTGGAGGCTGAGGATGTTGGGATT TATTACTGCATGCAAGCTCTACAAACT CCGCTCACTTTCGGCGGAGGGACCAAG GTGGAGATCAAAC SEQ ID NO: 589 | DIVMTQSPLSL PVTPGEPASIS CRSSQSLLHSN GFNYFDWYLQK PGQSPQLLIFL VSNRASGVPDR FSGSGSGTDFT LKISRVEAEDV GIYYCMQALQT PLTFGGGTKVE IK SEQ ID NO: 590 | QSLLHS NGFNY SEQ ID NO: 591 | LVS SEQ ID NO: 592 | MQALQT PLT SEQ ID NO: 593 |
| CL-64536 | GATATTGTGATGACTCAGTCTCCACTC TCCCTGCCCGTCACCCCTGGAGAGCCG GCCTCCATCTCCTGCAGGTCTAGTCAG AGCCTCCTGCATAGTAATGGATACAAC TGTTTGGATTGGTACCTGCAGAAGCCA GGGCAGTCTCCACAGCTCCTGATCTAT TTGGGTTCTACTCGGGCCTCCGGGTTC CCTGACAGGTTCAGTGGCAGTGGATCA GGCACAGATTTTACACTGAAAATCAGC AGAGTGGAGGCTGAGGATGTTGGGGTT | DIVMTQSPLSL PVTPGEPASIS CRSSQSLLHSN GYNCLDWYLQK PGQSPQLLIYL GSTRASGFPDR FSGSGSGTDFT LKISRVEAEDV GVYYCMQALQT PCSFGQGTKLE | QSLLHS NGYNC SEQ ID NO: 596 | LGS SEQ ID NO: 371 | MQALQTPCS SEQ ID NO: 400 |

TABLE S5-continued

Sequences of anti-ICOS antibody light chain variable regions
obtained from additional clones
N terminal E and 5' nucleotide additions in CL-71642 are
shown in bold. These were not recovered in sequencing but were
determined to be present in the sequence by comparison
against related clones. CDRs are defined according to IMGT.

| CLONE_ID | VL_NUCLEOTIDE_SEQUENCE | VL_AMINO_ACID_SEQ | LCDR1 | LCDR2 | LCDR3 |
|---|---|---|---|---|---|
| | TATTACTGCATGCAAGCTCTACAAACT CCGTGCAGTTTTGGCCAGGGGACCAAG CTGGAGATCAAAC SEQ ID NO: 594 | IK SEQ ID NO: 595 | | | |
| CL-64837 | GATATTGTGATGACTCAGTCTCCACTC TCCCTGCCCGTCACCCCTGGAGAGCCG GCCTCCATCTCCTGCAGGTCTAGTCAG AGCCTCCTGCATAGTAATGGATACAAC TGTTTGGATTGGTACCTGCAGAAGCCA GGGCAGTCTCCACAGCTCCTGATCTAT TTGGGTTCTACTCGGGCCTCCGGGTTC CCTGACAGGTTCAGTGGCAGTGGATCA GGCACAGATTTTACACTGAAAATCAGC AGAGTGGAGGCTGAGGATGTTGGGGTT TATTACTGCATGCAAGCTCTACAAACT CCGTGCAGTTTTGGCCAGGGGACCAAG CTGGAGATCAAAC SEQ ID NO: 597 | DIVMTQSPLSL PVTPGEPASIS CRSSQSLLHSN GYNCLDWYLQK PGQSPQLLIYL GSTRASGFPDR FSGSGSGTDFT LKISRVEAEDV GVYYCMQALQT PCSFGQGTKLE IK SEQ ID NO: 598 | QSLLHS NGYNC SEQ ID NO: 596 | LGS SEQ ID NO: 371 | MQALQTPCS SEQ ID NO: 400 |
| CL-64841 | GATATTGTGATGACTCAGTCTCCACTC TCCCTGCCCGTCACCCCTGGAGAGCCG GCCTCCATCTCCTGCAGGTCTAGTCAG AGCCTCCTGCATAGTAATGGATACAAC TGTTTGGATTGGTACCTGCAGAAGCCA GGGCAGTCTCCACAGCTCCTGATCTAT TTGGGTTCTACTCGGGCCTCCGGGTTC CCTGACAGGTTCAGTGGCAGTGGATCA GGCACAGATTCTACACTGAAAATCAGC AGAGTGGAGGCTGAGGATGTTGGGGTT TATTACTGCATGCAAGCTCTACAAACT CCGTGCAGTTTTGGCCAGGGGACCAAG CTGGAGATCAAAC SEQ ID NO: 599 | DIVMTQSPLSL PVTPGEPASIS CRSSQSLLHSN GYNCLDWYLQK PGQSPQLLIYL GSTRASGFPDR FSGSGSGTDST LKISRVEAEDV GVYYCMQALQT PCSFGQGTKLE IK SEQ ID NO: 600 | QSLLHS NGYNC SEQ ID NO: 596 | LGS SEQ ID NO: 371 | MQALQTPCS SEQ ID NO: 400 |
| CL-64912 | GATATTGTGATGACTCAGTCTCCACTC TCCCTGCCCGTCACCCCTGGAGAGCCG GCCTCCATCTCCTGCAGGTCTAGTCAG AGCCTCCTGCATAGTAATGGATACAAC TGTTTGGATTGGTACCTGCAGAAGCCA GGGCAGTCTCCACAGCTCCTGATCTAT TTGGGTTCTACTCGGGCCTCCGGGTTC CCTGACAGGTTCAGTGGCAGTGGATCA GGCACAGATTTTACACTGAAAATCAGC AGAGTGGAGGCTGAGGATGTTGGGGTT TATTACTGCATGCAAGCTCTACAAACT CCGTGCAGTTTTGGCCAGGGGACCAAG CTGGAGATCAAAC SEQ ID NO: 601 | DIVMTQSPLSL PVTPGEPASIS CRSSQSLLHSN GYNCLDWYLQK PGQSPQLLIYL GSTRASGFPDR FSGSGSGTDFT LKISRVEAEDV GVYYCMQALQT PCSFGQGTKLE IK SEQ ID NO: 602 | QSLLHS NGYNC SEQ ID NO: 596 | LGS SEQ ID NO: 371 | MQALQTPCS SEQ ID NO: 400 |
| CL-71642 | GAAATTGTGTTGACGCAGTCTCCAGGC ACCCTGTCTTTGTCTCCAGGGGAAAGA GCCACCCTCTCCTGCAGGGCCAGTCAG AGTGTTAGCAGCAGCTACTTAGCCTGG TACCAGCAGAAACCTGGCCAGGCTCCC AGGCTCCTCATCTATGGTGCATCCAGC AGGGCCACTGGCATCCCAGACAGGTTC AGTGGCAGTGGGTCTGGGACAGACTTC ACTCTCACCATCAGCAGACTGGAGCCT GAAGATTTTGCAGTGTATTACTGTCAG CAGTATGGTAGCTCACCTTTCACTTTC GGCCCTGGGACCAAAGTGGATATCAAA C SEQ ID NO: 603 | EIVLTQSPGTL SLSPGERATLS CRASQSVSSSY LAWYQQKPGQA PRLLIYGASSR ATGIPDRFSGS GSGTDFTLTIS RLEPEDFAVYY CQQYGSSPFTF GPGTKVDIK SEQ ID NO: 604 | QSVSSS Y SEQ ID NO: 426 | GAS SEQ ID NO: 413 | QQYGSSPFT SEQ ID NO: 605 |
| CL-74570 | GAAATTGTGTTGACGCAGTCTCCAGGC ACCCTGTCTTTGTCTCCAGGGGAAAGA GCCACCCTCTCCTGCAGGGCCAGTCAG AGTGTTAGCAGCAGCTACTTAGCCTGG TACCAGCAGAAACCTGGCCAGGCTCCC | EIVLTQSPGTL SLSPGERATLS CRASQSVSSSY LAWYQQKPGQA PRLLIYGASSR | QSVSSS Y SEQ ID NO: 426 | GAS SEQ ID NO: 413 | HQYGNSPFT SEQ ID NO: 608 |

TABLE S5-continued

Sequences of anti-ICOS antibody light chain variable regions obtained from additional clones
N terminal E and 5' nucleotide additions in CL-71642 are shown in bold. These were not recovered in sequencing but were determined to be present in the sequence by comparison against related clones. CDRs are defined according to IMGT.

| CLONE_ID | VL_NUCLEOTIDE_SEQUENCE | VL_AMINO_ACID_SEQ | LCDR1 | LCDR2 | LCDR3 |
|---|---|---|---|---|---|
| | AGGCTCCTCATCTATGGTGCATCCAGC AGGGCCACTGGCATCCCAGACAGGTTC AGTGGCAGTGGGTCTGGGACAGACTTC ACTCTCACCATCAGCAGACTGGAACCT GAAGATTTTGCAGTATATTACTGTCAC CAGTATGGTAATTCACCATTCACTTTC GGCCCTGGGACCAAAGTGGATATCAAA C SEQ ID NO: 606 | ATGIPDRFSGS GSGTDFTLTIS RLEPEDFAVYY CHQYGNSPFTF GPGTKVDIK SEQ ID NO: 607 | | | |

Fcab 289 Fc Sequence:

TCPPCP<u>APELLGGPSVFLFPPKPKDTLMISRTPEVTCVVVDVSHEDPEVK</u>

<u>FNWYVDGVEVHNAKTKPREEQYNSTYRVVSVLTVLHQDWLNGKEYKCKVS</u>

<u>NKALPAPIEKTISKAKG</u>QPREPQVYTLPPSRDE[SGYW]VSLTCLVKGFYPS

DIAVEWESNG[EPQYWA]KTTPPVLDSDGSFFLYSKLTV[SNWRWQLDD]FSCS

VMHEALHNHYTQKSLSLSPGK

SEQ ID NO: 620, in which the AB loop (SEQ ID NO: 617), CD loop (SEQ ID NO: 618), and EF loop (SEQ ID NO: 619) are boxed. CH2 domain SEQ ID NO: 613 is double underlined. CH3 domain SEQ ID NO: 616 is single underlined. See also FIG. 2.

STIM001_289 mAb2 Sequences:

Variable domain underlined. Leader in bold italic.
Heavy Chain
*MDWTWSIIFLVAAATGAHS*<u>QVQVVQSGAEVKKPGASVKVSCKASGYTFS</u>

<u>TFGITWVRQAPGQGLEWMGWISAYNGDTNYAQNLQGRVIMTTDTSTSTA</u>

<u>YMELRSLRSDDTAVYYCARSSGHYYYYGMDVWGQGTTVTVSS</u>ASTKGPS

VFPLAPSSKSTSGGTAALGCLVKDYFPEPVTVSWNSGALTSGVHTFPAV

LQSSGLYSLSSVVTVPSSSLGTQTYICNVNHKPSNTKVDKKVEPKSCDK

THTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYK

CKVSNKALPAPIEKTISKAKGQPREPQVYTLPPSRDESGYWVSLTCLVK

GFYPSDIAVEWESNGEPQYWAKTTPPVLDSDGSFFLYSKLTVSNWRWQL

DDFSCSVMHEALHNHYTQKSLSLSPGK

HCDR1: GYTFSTFG

HCDR2: ISAYNGDT

HCDR3: ARSSGHYYYYGMDV

*ATGGACTGGACCTGGAGCATCCTTTTCTTGGTGGCAGCAGC*

*AACAGGTGCCCACTCC*CAGGTTCAGGTGGTGCAGTCTGGAGCTGAGG

TGAAGAAGCCTGGGGCCTCAGTGAAGGTCTCCTGCAAGGCTTCTGGTTA

CACCTTTTCCACCTTTGGTATCACCTGGGTGCGACAGGCCCCTGGACAA

GGGCTTGAATGGATGGGATGGATCAGCGCTTACAATGGTGACACAAACT

ATGCACAGAATCTCCAGGGCAGAGTCATCATGACCACAGACACATCCAC

GAGCACAGCCTACATGGAGCTGAGGAGCCTGAGATCTGACGACACGGCC

GTTTATTACTGTGCGAGGAGCAGTGGCCACTACTACTACTACGGTATGG

ACGTCTGGGGCCAAGGGACCACGGTCACCGTCTCCTCAGCCAGCACCAA

GGGCCCCTCTGTGTTCCCTCTGGCCCCTTCCAGCAAGTCCACCTCTGGC

GGAACAGCCGCTCTGGGCTGCCTCGTGAAGGACTACTTCCCCGAGCCTG

TGACCGTGTCCTGGAACTCTGGCGCTCTGACCAGCGGAGTGCACACCTT

CCCTGCTGTGCTGCAGTCCTCCGGCCTGTACTCCCTGTCCTCCGTCGTG

ACCGTGCCTTCCAGCTCTCTGGGCACCCAGACCTACATCTGCAACGTGA

ACCACAAGCCCTCCAACACCAAGGTGGACAAGAAGGTGGAACCCAAGTC

CTGCGACAAGACCCACACCTGTCCCCCTTGTCCTGCCCCTGAACTGCTG

GGCGGACCTTCCGTGTTCCTGTTCCCCCCAAAGCCCAAGGACACCCTGA

TGATCTCCCGGACCCCCGAAGTGACCTGCGTGGTGGTGGATGTGTCCCA

CGAGGACCCTGAAGTGAAGTTCAATTGGTACGTGGACGGCGTGGAAGTG

CACAACGCCAAGACCAAGCCTAGAGAGGAACAGTACAACTCCACCTACC

GGGTGGTGTCCGTGCTGACCGTGCTGCACCAGGATTGGCTGAACGGCAA

AGAGTACAAGTGCAAGGTGTCCAACAAGGCCCTGCCTGCCCCCATCGAA

AAGACCATCTCCAAGGCCAAGGGCCAGCCCCGGGAACCCCAGGTGTACA

CACTGCCCCCTAGCAGGGACGAGAGCGGGTACTGGGTGTCCCTGACCTG

TCTCGTGAAAGGCTTCTACCCCTCCGATATCGCCGTGGAATGGGAGTCC

AACGGCGAGCCTCAGTACTGGGCCAAGACCACCCCCCCTGTGCTGGACT

CCGACGGCTCATTCTTCCTGTACAGCAAGCTGACAGTGAGCAACTGGCG

GTGGCAGCTGGACGACTTCTCCTGCTCCGTGATGCACGAGGCCCTGCAC

AACCACTACACCCAGAAGTCCCTGTCCCTGAGCCCCGGCAAG

-continued

Light Chain
MRLPAQLLGLLMLWVSGSSG<u>DIVMTQSPLSLPVTPGEPASISCRSSQS</u>
<u>LLHSNEYNYLDWYLQKPGQSPQLLIFLGSNRASGVPDRFSGSGSGTDFT</u>
<u>LKITRVEAEDVGIYYCMQSLQTPLTFGGGTKVEIK</u>RTVAAPSVFIFPPS
DEQLKSGTASVVCLLNNFYPREAKVQWKVDNALQSGNSQESVTEQDSKD
STYSLSSTLTLSKADYEKHKVYACEVTHQGLSSPVTKSFNRGEC

LCDR1: QSLLHSNEYNY

LCDR2: LGS

LCDR3: MQSLQTPLT

*ATGAGGCTCCCTGCTCAGCTCCTGGGGCTGCTAATGCTCT*
*GGGTCTCTGGATCCAGTGGT*GATATTGTGATGACTCAGTCTCCACTC
TCCCTGCCCGTCACCCCTGGAGAGCCGGCCTCCATCTCCTGCAGGTCTA
GTCAGAGCCTCCTGCATAGTAATGAATACAACTATTTGGATTGGTACCT
GCAGAAGCCAGGGCAGTCTCCACAGCTCCTGATCTTTTTGGGTTCTAAT
CGGGCCTCCGGGGTCCCTGACAGGTTCAGTGGCAGTGGATCAGGCACAG
ATTTTACACTGAAAATCACCAGAGTGGAGGCTGAGGATGTTGGAATTTA
TTACTGCATGCAATCTCTACAAACTCCGCTCACTTTCGGCGGAGGGACC
AAGGTGGAGATCAAACGTACGGTGGCCGCTCCCTCCGTGTTCATCTTCC
CACCTTCCGACGAGCAGCTGAAGTCCGGCACCGCTTCTGTCGTGTGCCT
GCTGAACAACTTCTACCCCCGCGAGGCCAAGGTGCAGTGGAAGGTGGAC
AACGCCCTGCAGTCCGGCAACTCCCAGGAATCCGTGACCGAGCAGGACT
CCAAGGACAGCACCTACTCCCTGTCCTCCACCCTGACCCTGTCCAAGGC
CGACTACGAGAAGCACAAGGTGTACGCCTGCGAAGTGACCCACCAGGGC
CTGTCTAGCCCCGTGACCAAGTCTTTCAACCGGGGCGAGTGT

STIM003_289 mAb2 Sequences:

Variable domain underlined. Leader in bold italic.
Heavy Chain
MEFGLSWVFL*VA*ILKGVQC<u>EVQLVESGGGVVRPGGSLRLSCVASGV</u>
<u>TFDDYGMSWVRQAPGKGLEWVSGINWNGGDTDYSDSVKGRFTISRDN</u>
<u>AKNSLYLQMNSLRAEDTALYYCARDFYGSGSYYHVPFDYWGQGILVT</u>
<u>VSS</u>ASTKGPSVFPLAPSSKSTSGGTAALGCLVKDYFPEPVTVSWNSG
ALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISR
TPEVTCVVVDVSHEDPEVKFNWYVDGVEVHNAKTKPREEQYNSTYRV
VSVLTVLHQDWLNGKEYKCKVSNKALPAPIEKTISKAKGQPREPQVY
TLPPSRDESGYWVSLTCLVKGFYPSDIAVEWESNGEPQYWAKTTPPV
LDSDGSFFLYSKLTVSNWRWQLDDFSCSVMHEALHNHYTQKSLSLSP
GK

HCDR1: GVTFDDYG

HCDR2: INWNGGDT

HCDR3: ARDFYGSGSYYHVPFDY

Heavy chain aa sequence without leader
SEQ ID NO: 621

Heavy chain aa sequence including leader
SEQ ID NO: 622

Heavy chain encoding nucleic acid SEQ ID NO: 612.
*ATGGAGTTTGGGCTGAGCTGGGTCTTCCTTGTTGCTA*
*TTTTAAAAGGTGTCCAGTGT*GAGGTGCAGCTGGTGGAGTCTGGGGG
AGGTGTGGTACGGCCTGGGGGTCCCTGAGACTCTCCTGTGTAGCCT
CTGGAGTCACCTTTGATGATTATGGCATGAGCTGGGTCCGCCAAGCT
CCAGGGAAGGGGCTGGAGTGGGTCTCTGGTATTAATTGGAATGGTGG
CGACACAGATTATTCAGACTCTGTGAAGGGCCGATTCACCATCTCCA
GAGACAACGCCAAGAACTCCCTGTATCTACAAATGAATAGTCTGAGA
GCCGAGGACACGGCCTTGTATTACTGTGCGAGGGATTTCTATGGTTC
GGGGAGTTATTATCACGTTCCTTTTGACTACTGGGGCCAGGGAATCC
TGGTCACCGTCTCCTCAGCCAGCACCAAGGGCCCCTCTGTGTTCCCT
CTGGCCCCTTCCAGCAAGTCCACCTCTGGCGGAACAGCCGCTCTGGG
CTGCCTCGTGAAGGACTACTTCCCCGAGCCTGTGACCGTGTCCTGGA
ACTCTGGCGCTCTGACCAGCGGAGTGCACACCTTCCCTGCTGTGCTG
CAGTCCTCCGGCCTGTACTCCCTGTCCTCCGTCGTGACCGTGCCTTC
CAGCTCTCTGGGCACCCAGACCTACATCTGCAACGTGAACCACAAGC
CCTCCAACACCAAGGTGGACAAGAAGGTGGAACCCAAGTCCTGCGAC
AAGACCCACACCTGTCCCCCTTGTCCTGCCCCTGAACTGCTGGGCGG
ACCTTCCGTGTTCCTGTTCCCCCCAAAGCCCAAGGACACCCTGATGA
TCTCCCGGACCCCCGAAGTGACCTGCGTGGTGGTGGATGTGTCCCAC
GAGGACCCTGAAGTGAAGTTCAATTGGTACGTGGACGGCGTGGAAGT
GCACAACGCCAAGACCAAGCCTAGAGAGGAACAGTACAACTCCACCT
ACCGGGTGGTGTCCGTGCTGACCGTGCTGCACCAGGATTGGCTGAAC
GGCAAAGAGTACAAGTGCAAGGTGTCCAACAAGGCCCTGCCTGCCCC
CATCGAAAAGACCATCTCCAAGGCCAAGGGCCAGCCCCGGGAACCCC
AGGTGTACACACTGCCCCCTAGCAGGGACGAGAGCGGGTACTGGGTG
TCCCTGACCTGTCTCGTGAAAGGCTTCTACCCCTCCGATATCGCCGT
GGAATGGGAGTCCAACGGCGAGCCTCAGTACTGGGCCAAGACCACCC
CCCCTGTGCTGGACTCCGACGGCTCATTCTTCCTGTACAGCAAGCTG
ACAGTGAGCAACTGGCGGTGGCAGCTGGACGACTTCTCCTGCTCCGT
CCGTGATGCACGAGGCCCTGCACAACCACTACACCCAGAAGTCCCTG
TCCCTGAGCCCCGGCAAG Light Chain
METPAHLLFILLLWLPDTTG<u>EIVLTQSPGTLSLSPGERATLSCRA</u>
<u>SQSVSRSYLAWYQQKRGQAPRLLIYGASSRATGIPDRFSGDGSGTDF</u>
<u>TLSISRLEPEDFAVYYCHQYDMSPFTFGPGTKVDIK</u>RTVAAPSVFIF -continued

PPSDEQLKSGTASVVCLLNNFYPREAKVQWKVDNALQSGNSQESVTE

QDSKDSTYSLSSTLTLSKADYEKHKVYACEVTHQGLSSPVTKSFNRG
EC

LCDR1: QSVSRSY

LCDR2: GAS

LCDR3: HQYDMSPFT

Light chain aa sequence without leader
SEQ ID NO: 623

Light chain aa sequence with leader
SEQ ID NO: 624

Light chain encoding nucleic acid SEQ ID NO: 614.
*ATGGAAACCCCAGCGCACCTTCTCTTCCTCCTGCTACTCTGG*

*CTCCCAGATACCACCGGA*GAAATTGTGTTGACGCAGTCTCCAGGG

ACCCTGTCTTTGTCTCCAGGGGAAAGAGCCACCCTCTCCTGCAGGG

CCAGTCAGAGTGTTAGCAGAAGCTACTTAGCCTGGTACCAGCAGAA

ACGTGGCCAGGCTCCCAGGCTCCTCATCTATGGTGCATCCAGCAGG

GCCACTGGCATCCCAGACAGGTTCAGTGGCGATGGGTCTGGGACAG

ACTTCACTCTCTCCATCAGCAGACTGGAGCCTGAAGATTTTGCAGT

GTATTACTGTCACCAGTATGATATGTCACCATTCACTTTCGGCCCT

GGGACCAAAGTGGATATCAAACGTACGGTGGCCGCTCCCTCCGTGT

TCATCTTCCCACCTTCCGACGAGCAGCTGAAGTCCGGCACCGCTTC

TGTCGTGTGCCTGCTGAACAACTTCTACCCCCGCGAGGCCAAGGTG

CAGTGGAAGGTGGACAACGCCCTGCAGTCCGGCAACTCCCAGGAAT

CCGTGACCGAGCAGGACTCCAAGGACAGCACCTACTCCCTGTCCTC

CACCCTGACCCTGTCCAAGGCCGACTACGAGAAGCACAAGGTGTAC

GCCTGCGAAGTGACCCACCAGGGCCTGTCTAGCCCCGTGACCAAGT

CTTTCAACCGGGCGAGTGT

REFERENCES

1 Dong, H., et al. (1999), "PD-L1, a third member of the B7 family, co-stimulates T-cell proliferation and interleukin-10 secretion," Nat. Med. 5 (12), 1365-1369
2 Brahmer et al., Journal of Clinical Oncology, 2010
3 Topalian et al., NEJM, 2012
4 Herbst R S, et al., "Predictive correlates of response to the anti-PD-L1 antibody MPDL3280A in cancer patients", Nature, 2014, Nov. 27, 515(7528):563-7, doi: 10.1038/nature14011
5 Fehrenbacher et al., 2016, The Lancet, http://doi.org/10.1016/50140-6736(16)00587-0
6 Rosenberg et al., 2016, The Lancet, http://doi.org/10.1016/S0140-6736(16)00561-4
7 Hutloff A, et al. ICOS is an inducible T-cell co-stimulator structurally and functionally related to CD28. Nature. 1999 Jan. 21; 397(6716):263-6.
8 Beier K C, et al. Induction, binding specificity and function of human ICOS. Eur J Immunol. 2000 December; 30(12):3707-17.
9 Coyle A J, et al. The CD28-related molecule ICOS is required for effective T cell-dependent immune responses. Immunity. 2000 July; 13(1):95-105.
10 Dong C, et al. ICOS co-stimulatory receptor is essential for T-cell activation and function. Nature. 2001 Jan. 4; 409(6816):97-101.
11 Mak T W, et al. Costimulation through the inducible costimulator ligand is essential for both T helper and B cell functions in T cell-dependent B cell responses. Nat Immunol. 2003 August; 4(8):765-72.
12 Swallow M M, Wallin J J, Sha W C. B7h, a novel costimulatory homolog of B7.1 and B7.2, is induced by TNFalpha. Immunity. 1999 October; 11(4):423-32.
13 Wang S, et al. Costimulation of T cells by B7-H2, a B7-like molecule that binds ICOS. Blood. 2000 Oct. 15; 96(8):2808-13.
14 Conrad C, Gilliet M. Plasmacytoid dendritic cells and regulatory T cells in the tumor microenvironment: A dangerous liaison. Oncoimmunology. 2013 May 1; 2(5): e2388.
15 Simpson et al., Fc-dependent depletion of tumor-infiltrating regulatory T cells co-defines the efficacy of anti-CTLA-4 therapy against melanoma. J. Exp. Med. 210(9): 1695-1710 2013
16 Fu T, He Q, Sharma P. The ICOS/ICOSL pathway is required for optimal antitumor responses mediated by anti-CTLA-4 therapy. Cancer Res. 2011 Aug. 15; 71(16): 5445-54.
17 Fan X, Quezada S A, Sepulveda M A, Sharma P, Allison J P. Engagement of the ICOS pathway markedly enhances efficacy of CTLA-4 blockade in cancer immunotherapy. J Exp Med. 2014 Apr. 7; 211(4):715-25.
18 Carthon, B. C., et al. Preoperative CTLA-4 blockade: Tolerability and immune monitoring in the setting of a presurgical clinical trial. Clin. Cancer Res. 16:2861-2871.
19 Liakou C I, et al. CTLA-4 blockade increases IFN-gamma-producing CD4+ICOShi cells to shift the ratio of effector to regulatory T cells in cancer patients. Proc Natl Acad Sci USA. 2008 Sep. 30; 105(39):14987-92.
20 Vonderheide, R. H., et al. 2010. Tremelimumab in combination with exemestane in patients with advanced breast cancer and treatment-associated modulation of inducible costimulator expression on patient T cells. Clin. Cancer Res. 16:3485-3494.
21 Larkin J., et al. NEJM 373(1):23-34 2015
22 Larkin J., et al. The Oncologist 11 May 2017
23 Lefranc M P, IMGT unique numbering for immunoglobulin and T cell receptor variable domains and Ig superfamily V-like domains, Dev Comp Immunol. 27(1):55-77 2003
24 Gül et al., "Antibody-Dependent Phagocytosis of Tumor Cells by Macrophages: A Potent Effector Mechanism of Monoclonal Antibody Therapy of Cancer", Cancer Res., 75(23), Dec. 1, 2015
25 Lazar et al., 2006, Proc. Natl. Acad. Sci. U.S.A., March 14; 103(11):4005-10
26 Dall et al., Immunol 2002; 169:5171-5180
27 Natsume et al., 2009, Drug Des. Devel. Ther., 3:7-16 or by Zhou Q., Biotechnol. Bioeng., 2008, Feb. 15, 99(3): 652-65)
28 Shields et al., 2001, J. Biol. Chem., March 2; 276(9): 6591-604)
29 Idusogie et al., J. Immunol., 2001, 166:2571-2575
30 Natsume et al., 2008, Cancer Res., 68: 3863-3872

31 Chattopadhyay et al., Structural Basis of Inducible Costimulatory Ligand Function: Determination of the Cell Surface Oligomeric State and Functional Mapping of the Receptor Binding Site of the Protein, J. Immunol. 177(6):3920-3929 2006
32 Alexandrov L B, et al. Signatures of mutational processes in human cancer. Nature. 2013 Aug. 22; 500(7463):415-21
33 Martin-Orozco et al., Melanoma Cells Express ICOS Ligand to Promote the Activation and Expansion of T-Regulatory Cells, Cancer Research 70(23):9581-9590 2010
34 Houot et al., Therapeutic effect of CD137 immunomodulation in lymphoma and its enhancement by Treg depletion, Blood 114:3431-3438 2009

SEQUENCE LISTING (624 sequences)

SEQ ID NO: 1 - protein, 290 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 2 - protein, 241 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERT

SEQ ID NO: 3 - protein, 245 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHHHHHH

SEQ ID NO: 4 - protein, 475 aa, Homo Sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 249 aa, Cynomologus
MGWSCIILFLVATATGVHSMFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERTDYKDDDDK

SEQ ID NO: 6 - protein, 405 aa, Homo Sapiens
MGWSCIILFLVATATGVHSLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQKLENLYFQGIEGRMDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 7 - protein, 8 aa, Homo Sapiens
GFTFDDYA

SEQ ID NO: 8 - protein, 8 aa, Homo Sapiens
ISWKSNII

SEQ ID NO: 9 - protein, 15 aa, Homo Sapiens
ARDITGSGSYGWFDP

SEQ ID NO: 10 - protein, 5 aa, Homo Sapiens
DYAMH

SEQ ID NO: 11 - protein, 17 aa, Homo Sapiens
GISWKSNIIGYADSVKG

SEQ ID NO: 12 - protein, 13 aa, Homo Sapiens
DITGSGSYGWFDP

SEQ ID NO: 13 - protein, 122 aa, Homo Sapiens
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSS

SEQ ID NO: 14 - DNA, 508 bp, Homo Sapiens
caagaaaaagcttgccgccaccatggagtttgggctgagctggattttccttttggctattttaaaaggtgtccagtgtgaagtacaattggtggagtccgggggaggcttggtacagcctggcaggtccctgagactctcctgtgcagcctctggattcacctttgatgattatgccatgcactgggtccgacaaactccagggaagggcctggagtgggtctcaggtataagttggaagagtaatatcataggctatgcggactctgtgaagggccgattcaccatctccagagacaacgccaagaactccctgtatctgcaaatgaacagtctgagagctgaggacacggccttgtattattgtgcaagagatataacgggttcggggagttatggctggttcgacccctggggccagggaaccctggtcaccgtctcctcagccaaaacgacacccccatctgtctatccactggcccctgaatctgctaaaactcagcctccg

SEQ ID NO: 15 - protein, 449 aa, Homo Sapiens
EVQLVESGGGLVQPGRSLRLSCAASGFTFDDYAMHWVRQTPGKGLEWVSGISWKSNIIGYADSVKGRFTISRDNAKNSLYLQMNSLRAEDTALYYCARDITGSGSYGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16 - DNA, 1356 bp, Homo Sapiens
gaagtgcagctggtggaatctggcggcggactggtgcagcctggcagatccctgagactgtcttgtgccgcctccggcttcaccttcgacgactacgctatgcactgggtgcgacagacccctggcaagggcctggaatgggtgtccggcatctcctggaagtccaacatcatcggctacgccgactccgtgaagggccggttcaccatctcccgggacaacgccaagaactccctgtacctgcagatgaacagcctgcgggccgaggacaccgccctgtactactgcgccagagacatcaccggctccggctcctacggatggttcgatccttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 17 - protein, 6 aa, Homo Sapiens
QSISSY

SEQ ID NO: 18 - protein, 3 aa, Homo Sapiens
VAS

SEQ ID NO: 19 - protein, 9 aa, Homo Sapiens
QQSYSNPIT

SEQ ID NO: 20 - protein, 11 aa, Homo Sapiens
RASQSISSYLN

SEQ ID NO: 21 - protein, 7 aa, Homo Sapiens
VASSLQS

SEQ ID NO: 22 - protein, 9 aa, Homo Sapiens
QQSYSNPIT

SEQ ID NO: 23 - protein, 107 aa, Homo Sapiens
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIK

SEQ ID NO: 24 - DNA, 321 bp, Homo Sapiens
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaa

SEQ ID NO: 25 - protein, 214 aa, Homo Sapiens
DIQMTQSPSSLSASVGDRVTITCRASQSISSYLNWYQQKPGKAPKPLIYVASSLQSGVPSSFSGSGSGTDFTLTISSLQPEDFATYYCQQSYSNPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - DNA, 642 bp, Homo Sapiens
gacatccagatgacccagtctccatcctccctgtctgcatctgtaggagacagagtcaccatcacttgccgggcaagtcagagcattagcagctatttaaattggtatcagcagaaaccagggaaagcccctaagcccctgatctatgttgcatccagtttgcaaagtggggtcccatcaagtttcagtggcagtggatctgggacagatttcactctcaccatcagcagtctgcaacctgaagattttgcaacttactactgtcaacagagttacagtaatccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 27 - protein, 8 aa, Homo Sapiens
GFTFDDYA

SEQ ID NO: 28 - protein, 8 aa, Homo Sapiens
ISWIRTGI

SEQ ID NO: 29 - protein, 16 aa, Homo Sapiens
AKDMKGSGTYGGWFDT

SEQ ID NO: 30 - protein, 5 aa, Homo Sapiens
DYAMH

SEQ ID NO: 31 - protein, 17 aa, Homo Sapiens
GISWIRTGIGYADSVKG

SEQ ID NO: 32 - protein, 14 aa, Homo Sapiens
DMKGSGTYGGWFDT

SEQ ID NO: 33 - protein, 123 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSS

SEQ ID NO: 34 - DNA, 482 bp, Homo Sapiens
aagcttgccgccaccatggagtttgggctgagctggattttccttttggctattttaaaaggtgtccagtgtgaagtgcagctggtggagtctgggggaggcttggtgcagcctggcaggtccctgagactctcctgtgcagcctctggattcacctttgatgattatgccatgcactgggtccggcaagttccagggaagggcctggaatgggtctcaggcattagttggattcgtactggcataggctatgcggactctgtgaagggccgattcaccattttcagagacaacgccaagaattccctgtatctgcaaatgaacagtctgagagctgaggacacggccttgtattactgtgcaaaagatatgaagggttcggggacttatggggggtggttcgacacctggggccagggaaccctggtcaccgtctcctcagccaaaacaacagccccatcggtctatccactggcccctgc

SEQ ID NO: 35 - protein, 450 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 36 - DNA, 1359 bp, Homo Sapiens
gaagtgcagctggtggaatctggcggcggactggtgcagcctggcagatccctgagactgtcttgtgccgcctccggcttcaccttcgacgactacgctatgcactgggtgcgacaggtgccaggcaagggcctggaatgggtgtccggcatctcttggatccggaccggcatcggctacgccgactctgtgaagggccggttcaccatcttccgggacaacgccaagaactccctgtacctgcagatgaacagcctgcgggccgaggacaccgccctgtactactgcgccaaggacatgaagggctccggcacctacggcggatggttcgatacttggggccagggcaccctcgtgaccgtgtcctctgccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 37 - protein, 6 aa, Homo Sapiens
QSISSY

SEQ ID NO: 38 - protein, 3 aa, Homo Sapiens
VAS

SEQ ID NO: 39 - protein, 9 aa, Homo Sapiens
QQSYSTPIT

SEQ ID NO: 40 - protein, 11 aa, Homo Sapiens
RASQSISSYLN

SEQ ID NO: 41 - protein, 7 aa, Homo Sapiens
VASSLQS

SEQ ID NO: 42 - protein, 9 aa, Homo Sapiens
QQSYSTPIT

SEQ ID NO: 43 - protein, 107 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIK

SEQ ID NO: 44 - DNA, 418 bp, Homo Sapiens
aaagcttgccgccaccatgaggctccctgctcagcttctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgttgcatccagtttgcaaagtggggtcccatcaaggttcagtggcagtggatctgggacagatttcactctcactatcagcagtctgcaacctgaagattttgcaacttactactgtcaacagagttacagtaccccgatcaccttcggccaagggacacgtctggagatcaaacgtacggatgctgcaccaact

SEQ ID NO: 45 - protein, 214 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - DNA, 642 bp, Homo Sapiens
gacatccagatgacccagtccccctccagcctgtctgcttccgtgggcgacagagtgaccatcacctgtcgggcctcccagtccatctcctcctacctgaactggtatcagcagaagcccggcaaggcccccaagctgctgatctacgtggccagctctctgcagtccggcgtgccctctagattctccggctctggctctggcaccgactttaccctgaccatcagctccctgcagcccgaggacttcgccacctactactgccagcagtcctactccacccctatcaccttcggccagggcacccggctggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 47 - protein, 450 aa, Homo Sapiens
EVQLVESGGGLVQPGRSLRLSCAASGFTFDDYAMHWVRQAPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 48 - protein, 450 aa, Homo Sapiens
EVQLVESGGGLVQPGRSLRLSCAASGFTFDDYAMHWVRQVPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 49 - protein, 448 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 50 - protein, 214 aa, Homo Sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 214 aa, Homo Sapiens
DIQMTQSPSSLSASVGDRVTITCRASQSISSYLNWYQQKPGKAPKLFIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 8 aa, Homo Sapiens
GFTFSSYW

SEQ ID NO: 53 - protein, 8 aa, Homo Sapiens
IKEDGSEK

SEQ ID NO: 54 - protein, 12 aa, Homo Sapiens
ARNRLYSDFLDN

SEQ ID NO: 55 - protein, 5 aa, Homo Sapiens
SYWMS

SEQ ID NO: 56 - protein, 17 aa, Homo Sapiens
NIKEDGSEKYYVDSVKG

SEQ ID NO: 57 - protein, 10 aa, Homo Sapiens
NRLYSDFLDN

SEQ ID NO: 58 - protein, 119 aa, Homo Sapiens
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSS

SEQ ID NO: 59 - DNA, 358 bp, Homo Sapiens
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcag

SEQ ID NO: 60 - protein, 449 aa, Homo Sapiens
EVQLVESGGGLVQPGGSLRLSCAASGFTFSSYWMSWVRQAPGKGLEWVANIKEDGSEKYYVDSVKGRFTISRDNAKNSLYLQMNSLRAEDTSVYYCARNRLYSDFLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 1347 bp, Homo Sapiens
gaggtgcagctggtggagtctgggggaggcttggtccagcctggggggtccctgagactctcctgtgcagcctctggattcacgtttagtagctattggatgagttgggtccgccaggctccagggaaggggctggagtgggtggccaacatcaaagaagatggaagtgagaaatactatgtcgactctgtgaagggccgattcaccatctccagagacaacgccaagaactcactgtatctgcaaatgaacagcctgagagccgaggacacgtctgtgtattactgtgcgagaaatcgactctacagtgacttccttgacaactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 62 - protein, 6 aa, Homo Sapiens
QGVSSW

SEQ ID NO: 63 - protein, 3 aa, Homo Sapiens
GAS

SEQ ID NO: 64 - protein, 9 aa, Homo Sapiens
QQANSIPFT

SEQ ID NO: 65 - protein, 11 aa, Homo Sapiens
RASQGVSSWLA

SEQ ID NO: 66 - protein, 7 aa, Homo Sapiens
GASSLQS

SEQ ID NO: 67 - protein, 9 aa, Homo Sapiens
QQANSIPFT

SEQ ID NO: 68 - protein, 107 aa, Homo Sapiens
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIK

SEQ ID NO: 69 - DNA, 322 bp, Homo Sapiens
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaac

SEQ ID NO: 70 - protein, 214 aa, Homo Sapiens
DIQMTQSPSSVSASVGDRVTITCRASQGVSSWLAWYQQKSGKAPKLLIYGASSLQSGVPSRFSGSGSGTEFILTISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - DNA, 642 bp, Homo Sapiens
gacatccagatgacccagtctccatcttccgtgtctgcatctgtcggagacagagtcaccatcacttgtcgggcgagtcagggtgttagcagctggttagcctggtatcagcagaaatcagggaaagcccctaagctcctgatctatggtgcatccagtttgcaaagtggggtcccatcaagattcagcggcagtggatctgggacagagttcattctcaccatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 72 - protein, 8 aa, Homo Sapiens
GFTFSSYW

SEQ ID NO: 73 - protein, 8 aa, Homo Sapiens
IKEDGSEK

SEQ ID NO: 74 - protein, 12 aa, Homo Sapiens
ARVRLYSDFLDY

SEQ ID NO: 75 - protein, 5 aa, Homo Sapiens
SYWMS

SEQ ID NO: 76 - protein, 17 aa, Homo Sapiens
NIKEDGSEKYYVDSLKG

SEQ ID NO: 77 - protein, 10 aa, Homo Sapiens
VRLYSDFLDY

SEQ ID NO: 78 - protein, 119 aa, Homo Sapiens
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSS

SEQ ID NO: 79 - DNA, 358 bp, Homo Sapiens
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcag

SEQ ID NO: 80 - protein, 449 aa, Homo Sapiens
EVQLVDSGGGLVQPGGSLRLSCAASGFTFSSYWMSWVRQAPGKGLEWVANIKEDGSEKYYVDSLKGRFTISRDNAKNSLYLQMNSLRAEDTSVYYCARVRLYSDFLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - DNA, 1347 bp, Homo Sapiens
gaggtgcagctggtggactctgggggaggcttggtccagcctggggggtccctgagactctcctgtgcagcctctggattcacgtttagtagctattggatgagttgggtccgccaggctccaggaaaggggctggagtgggtggccaacataaaagaagatggaagtgagaaatactatgtagactctttgaagggccgattcaccatctccagagacaacgccaagaactcactgtatctgcaaatgaacagcctgagagccgaggacacgtctgtgtattactgtgcgagagttcgactctacagtgacttccttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 82 - protein, 6 aa, Homo Sapiens
QGVSSW

SEQ ID NO: 83 - protein, 3 aa, Homo Sapiens
GAS

SEQ ID NO: 84 - protein, 9 aa, Homo Sapiens
QQANSIPFT

SEQ ID NO: 85 - protein, 11 aa, Homo Sapiens
RASQGVSSWLA

SEQ ID NO: 86 - protein, 7 aa, Homo Sapiens
GASSLQS

SEQ ID NO: 87 - protein, 9 aa, Homo Sapiens
QQANSIPFT

SEQ ID NO: 88 - protein, 107 aa, Homo Sapiens
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIK

SEQ ID NO: 89 - DNA, 322 bp, Homo Sapiens
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaac

SEQ ID NO: 90 - protein, 214 aa, Homo Sapiens
DIQMTQSPSSVSASVGDRVTITCRASQGVSSWLAWYQQKSGKAPKLLIYGASSLQSGVPSRFSGSGSGTEFILSISSLQPEDFATYYCQQANSIPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - DNA, 642 bp, Homo Sapiens
gacatccagatgacccagtctccatcttccgtgtctgcatctgtcggagacagagtcaccatcacttgtcgggcgagtcagggtgttagcagttggttagcctggtatcagcagaaatcagggaaagcccctaagctcctgatctatggtgcctccagtttgcaaagtggggtcccatcaagattcagcggcagtggatctgggacagagttcattctcagcatcagcagcctgcagcctgaagattttgcaacttactattgtcaacaggctaacagtatcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 92 - protein, 9 aa, Homo Sapiens
GGSIISSDW

SEQ ID NO: 93 - protein, 7 aa, Homo Sapiens
IFHSGRT

SEQ ID NO: 94 - protein, 8 aa, Homo Sapiens
ARDGSGSY

SEQ ID NO: 95 - protein, 6 aa, Homo Sapiens
SSDWWN

SEQ ID NO: 96 - protein, 16 aa, Homo Sapiens
EIFHSGRTNYNPSLKS

SEQ ID NO: 97 - protein, 6 aa, Homo Sapiens
DGSGSY

SEQ ID NO: 98 - protein, 115 aa, Homo Sapiens
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSS

SEQ ID NO: 99 - DNA, 346 bp, Homo Sapiens
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcag

SEQ ID NO: 100 - protein, 445 aa, Homo Sapiens
QVQLQESGPGLVKPSGTLSLTCIVSGGSIISSDWWNWVRQPPGKGLEWIGEIFHSGRTNYNPSLKSRVTISIDKSKNQFSLRLSSVTAADTAVYYCARDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - DNA, 1335 bp, Homo Sapiens
caggtgcagctgcaggagtcgggcccaggactggtgaagccttcggggaccctgtccctcacctgcattgtctctggtggctccatcatcagtagtgactggtggaattgggtccgccagcccccagggaaggggctggagtggattggagaaatctttcatagtgggaggaccaactacaacccgtccctcaagagtcgagtcaccatatcaatagacaagtccaagaatcagttctccctgaggctgagctctgtgaccgccgcggacacggccgtgtattactgtgcgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 102 - protein, 12 aa, Homo Sapiens
QSVLYSSNNKNY

SEQ ID NO: 103 - protein, 3 aa, Homo Sapiens
WAS

SEQ ID NO: 104 - protein, 8 aa, Homo Sapiens
QQYYSNRS

SEQ ID NO: 105 - protein, 17 aa, Homo Sapiens
KSSQSVLYSSNNKNYLA

SEQ ID NO: 106 - protein, 7 aa, Homo Sapiens
WASTRES

SEQ ID NO: 107 - protein, 8 aa, Homo Sapiens
QQYYSNRS

SEQ ID NO: 108 - protein, 112 aa, Homo Sapiens
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIK

SEQ ID NO: 109 - DNA, 337 bp, Homo Sapiens
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaac

SEQ ID NO: 110 - protein, 219 aa, Homo Sapiens
DIVMTQSPDSLAVSLGERATINCKSSQSVLYSSNNKNYLAWYQQKSGQPPKLLIYWASTRESGVPDRFSGSGSGTDFTLTISSLQTEDVAVYYCQQYYSNRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - DNA, 657 bp, Homo Sapiens
gacatcgtgatgacccagtctccagactccctggctgtgtctctgggcgagagggccaccatcaactgcaagtccagccagagtgttttatacagctccaacaataagaattacttagcttggtaccagcagaaatcaggacagcctcctaagttgctcatttactgggcatctacccgggaatccggggtccctgaccgattcagtggcagcgggtctgggacagatttcactctcaccatcagcagcctgcagactgaagatgtggcagtttattactgtcagcaatattatagtaatcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 112 - protein, 8 aa, Homo Sapiens
GFTFSSYW

SEQ ID NO: 113 - protein, 8 aa, Homo Sapiens
IKEDGSEK

SEQ ID NO: 114 - protein, 12 aa, Homo Sapiens
ARNRLYSDFLDN

SEQ ID NO: 115 - protein, 5 aa, Homo Sapiens
SYWMS

SEQ ID NO: 116 - protein, 17 aa, Homo Sapiens
NIKEDGSEKYYVDSVKG

SEQ ID NO: 117 - protein, 10 aa, Homo Sapiens
NRLYSDFLDN

SEQ ID NO: 118 - protein, 119 aa, Homo Sapiens; identical to SEQ ID NO: 58

SEQ ID NO: 119 - DNA, 358 bp, Homo Sapiens; identical to SEQ ID NO: 59

SEQ ID NO: 120 - protein, 449 aa, Homo Sapiens; identical to SEQ ID NO: 60

SEQ ID NO: 121 - DNA, 1347 bp, Homo Sapiens; identical to SEQ ID NO: 61

SEQ ID NO: 122 - protein, 6 aa, Homo Sapiens
QGVSSW

SEQ ID NO: 123 - protein, 3 aa, Homo Sapiens
GAS

SEQ ID NO: 124 - protein, 9 aa, Homo Sapiens
QQANSIPFT

SEQ ID NO: 125 - protein, 11 aa, Homo Sapiens
RASQGVSSWLA

SEQ ID NO: 126 - protein, 7 aa, Homo Sapiens
GASSLQS

SEQ ID NO: 127 - protein, 9 aa, Homo Sapiens
QQANSIPFT

SEQ ID NO: 128 - protein, 107 aa, Homo Sapiens; identical to SEQ ID NO: 68

SEQ ID NO: 129 - DNA, 322 bp, Homo Sapiens; identical to SEQ ID NO: 69

SEQ ID NO: 130 - protein, 214 aa, Homo Sapiens; identical to SEQ ID NO: 70

SEQ ID NO: 131 - DNA, 642 bp, Homo Sapiens; identical to SEQ ID NO: 71

SEQ ID NO: 132 - protein, 8 aa, Homo Sapiens
GFTFRIYG

SEQ ID NO: 133 - protein, 8 aa, Homo Sapiens
IWYDGSNK

SEQ ID NO: 134 - protein, 11 aa, Homo Sapiens
ARDMDYFGMDV

SEQ ID NO: 135 - protein, 5 aa, Homo Sapiens
IYGMH

SEQ ID NO: 136 - protein, 17 aa, Homo Sapiens
VIWYDGSNKYYADSVKG

SEQ ID NO: 137 - protein, 9 aa, Homo Sapiens
DMDYFGMDV

SEQ ID NO: 138 - protein, 118 aa, Homo Sapiens
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSS

SEQ ID NO: 139 - DNA, 355 bp, Homo Sapiens
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcag

SEQ ID NO: 140 - protein, 448 aa, Homo Sapiens
QVQLVESGGGVVQPGRSLRLSCAASGFTFRIYGMHWVRQAPGKGLEWVAVIWYDGSNKYYADSVKGRFTISRDNSDNTLYLQMNSLRAEDTAVYYCARDMDYFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - DNA, 1344 bp, Homo Sapiens
caggtgcagctggtggagtctgggggaggcgtggtccagcctgggaggtccctgagactctcctgtgcagcgtctggattcaccttccgtatttatggcatgcactgggtccgccaggctccaggcaaggggctggagtgggtggcagttatatggtatgatggaagtaataaatactatgctgactccgtgaagggccgattcaccatctccagagacaattccgacaacacgctgtatctgcaaatgaacagcctgagagccgaggacacggctgtgtattactgtgcgagagatatggactacttcggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 142 - protein, 6 aa, Homo Sapiens
QGIRND

SEQ ID NO: 143 - protein, 3 aa, Homo Sapiens
AAS

SEQ ID NO: 144 - protein, 9 aa, Homo Sapiens
LQHNSYPRT

SEQ ID NO: 145 - protein, 11 aa, Homo Sapiens
RASQGIRNDLG

SEQ ID NO: 146 - protein, 7 aa, Homo Sapiens
AASSLQS

SEQ ID NO: 147 - protein, 9 aa, Homo Sapiens
LQHNSYPRT

SEQ ID NO: 148 - protein, 107 aa, Homo Sapiens
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 149 - DNA, 322 bp, Homo Sapiens
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaac

SEQ ID NO: 150 - protein, 214 aa, Homo Sapiens
DLQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 151 - DNA, 642 bp, Homo Sapiens
gacctccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 152 - protein, 9 aa, Homo Sapiens
GGSISSSDW

SEQ ID NO: 153 - protein, 7 aa, Homo Sapiens
IFHSGNT

SEQ ID NO: 154 - protein, 8 aa, Homo Sapiens
VRDGSGSY

SEQ ID NO: 155 - protein, 6 aa, Homo Sapiens
SSDWWS

SEQ ID NO: 156 - protein, 16 aa, Homo Sapiens
EIFHSGNTNYNPSLKS

SEQ ID NO: 157 - protein, 6 aa, Homo Sapiens
DGSGSY

SEQ ID NO: 158 - protein, 115 aa, Homo Sapiens
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSS

SEQ ID NO: 159 - DNA, 346 bp, Homo Sapiens
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcag

SEQ ID NO: 160 - protein, 445 aa, Homo Sapiens
QVQLQESGPGLVKPSGTLSLTCAVSGGSISSSDWWSWVRQPPGKGLEWIGEIFHSGNTNYNPSLKSRVTISVDKSKNQISLRLNSVTAADTAVYYCVRDGSGSYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - DNA, 1335 bp, Homo Sapiens
caggtgcagctgcaggagtcgggcccaggactggtgaagccttcggggaccctgtccctcacctgcgctgtctctggtggctccatcagcagtagtgactggtggagttgggtccgccagcccccagggaaggggctggagtggattggggaaatctttcatagtgggaacaccaactacaacccgtccctcaagagtcgagtcaccatatcagtagacaagtccaagaaccagatctccctgaggctgaactctgtgaccgccgcggacacggccgtgtattactgtgtgagagatggttcggggagttactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 162 - protein, 12 aa, Homo Sapiens
QSVLYSSNNKNY

SEQ ID NO: 163 - protein, 3 aa, Homo Sapiens
WAS

SEQ ID NO: 164 - protein, 8 aa, Homo Sapiens
QQYYSTRS

SEQ ID NO: 165 - protein, 17 aa, Homo Sapiens
KSSQSVLYSSNNKNYLA

SEQ ID NO: 166 - protein, 7 aa, Homo Sapiens
WASTRES

SEQ ID NO: 167 - protein, 8 aa, Homo Sapiens
QQYYSTRS

SEQ ID NO: 168 - protein, 112 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIK

SEQ ID NO: 169 - DNA, 337 bp, Homo Sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaac

SEQ ID NO: 170 - protein, 219 aa, Homo Sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - DNA, 657 bp, Homo Sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaaactgctcatttactgggcatctacccgggaatccggggtccctgaccgattcagtggcagcgggtctgggacagatttcactctcaccatcagcagcctgcaggctgaagatgtggcagtttattactgtcagcaatattatagtactcgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 172 - protein, 10 aa, Homo Sapiens
GGSISSSSYY

SEQ ID NO: 173 - protein, 7 aa, Homo Sapiens
IYSTGYT

SEQ ID NO: 174 - protein, 13 aa, Homo Sapiens
AISTAAGPEYFHR

SEQ ID NO: 175 - protein, 7 aa, Homo Sapiens
SSSYYCG

SEQ ID NO: 176 - protein, 16 aa, Homo Sapiens
SIYSTGYTYYNPSLKS

SEQ ID NO: 177 - protein, 11 aa, Homo Sapiens
STAAGPEYFHR

SEQ ID NO: 178 - protein, 120 aa, Homo Sapiens
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSS

SEQ ID NO: 179 - DNA, 361 bp, Homo Sapiens
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcag

SEQ ID NO: 180 - protein, 450 aa, Homo Sapiens
QLQESGPGLVKPSETLSLTCTVSGGSISSSSYYCGWIRQPPGKGLDWIGSIYSTGYTYYNPSLKSRVTISIDTSKNQFSCLILTSVTAADTAVYYCAISTAAGPEYFHRWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - DNA, 1350 bp, Homo Sapiens
cagctgcaggagtcgggcccaggcctggtgaagccttcggagaccctgtccctcacctgcactgtctctggtggctccatcagcagtagtagttattactgcggctggatccgccagccccctgggaaggggctggactggattgggagtatctattctactgggtacacctactacaacccgtccctcaagagtcgagtcaccatttccatagacacgtccaagaaccagttctcatgcctgatactgacctctgtgaccgccgcagacacggctgtgtattactgtgcgataagtacagcagctggccctgaatacttccatcgctggggccagggcaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 182 - protein, 12 aa, Homo Sapiens
QSVLYSSNSKNF

SEQ ID NO: 183 - protein, 3 aa, Homo Sapiens
WAS

SEQ ID NO: 184 - protein, 9 aa, Homo Sapiens
QQYYSTPRT

SEQ ID NO: 185 - protein, 17 aa, Homo Sapiens
KSSQSVLYSSNSKNFLA

SEQ ID NO: 186 - protein, 7 aa, Homo Sapiens
WASTRGS

SEQ ID NO: 187 - protein, 9 aa, Homo Sapiens
QQYYSTPRT

SEQ ID NO: 188 - protein, 113 aa, Homo Sapiens
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIK

SEQ ID NO: 189 - DNA, 340 bp, Homo Sapiens
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaac

SEQ ID NO: 190 - protein, 220 aa, Homo Sapiens
DIVMTQSPDSLAVSLGERATINCKSSQSVLYSSNSKNFLAWYQQKPGQPPKLFIYWASTRGSGVPDRISGSGSGTDFNLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - DNA, 660 bp, Homo Sapiens
gacatcgtgatgacccagtctccagactccctggctgtgtctctgggcgagagggccaccatcaactgcaagtccagccagagtgttttatacagctccaacagtaagaacttcttagcttggtaccagcagaaaccgggacagcctcctaagctgttcatttactgggcatctacccggggatccggggtccctgaccgaatcagtggcagcgggtctgggacagatttcaatctcaccatcagcagcctgcaggctgaagatgtggcagtttattactgtcaacaatattatagtactcctcggacgttcggccaagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 192 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 193 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 194 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccgtgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcgtgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacgcagaagagcctctccctgtctctgggtaaa

SEQ ID NO: 195 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVVHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 196 - DNA, 981 bp, Homo Sapiens
gcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaagctcaccgtggacaagagcaggtggcaggaggggaacgtcttctcatgctccgtgatgcatgaggctctgcacaaccactacacgcagaagagcctctccctgtctctgggtaaa

SEQ ID NO: 197 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 198 - DNA, 981 bp, Homo Sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctgaatttgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 199 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 200 - DNA, 981 bp, Homo Sapiens
gcctccaccaagggacctagcgtgttccctctcgccccctgttccaggtccacaagcgagtccaccgctgccctcggctgtctggtgaaagactactttcccgagcccgtgaccgtctcctggaatagcggagccctgacctccggcgtgcacacatttcccgccgtgctgcagagcagcggactgtatagcctgagcagcgtggtgaccgtgcccagctccagcctcggcaccaaaacctacacctgcaacgtggaccacaagccctccaacaccaaggtggacaagcgggtggagagcaagtacggccccccttgccctccttgtcctgcccctgagttcgagggaggaccctccgtgttcctgtttccccccaaacccaaggacaccctgatgatctcccggacacccgaggtgacctgtgtggtcgtggacgtcagccaggaggaccccgaggtgcagttcaactggtatgtggacggcgtggaggtgcacaatgccaaaaccaagcccagggaggagcagttcaattccacctacagggtggtgagcgtgctgaccgtcctgcatcaggattggctgaacggcaaggagtacaagtgcaaggtgtccaacaagggactgcccagctccatcgagaagaccatcagcaaggctaagggccagccgagggagccccaggtgtataccctgcctcctagccaggaagagatgaccaagaaccaagtgtccctgacctgcctggtgaagggattctacccctccgacatcgccgtggagtgggagagcaatggccagcccgagaacaactacaaaacaacccctcccgtgctcgatagcgacggcagcttctttctctacagccggctgacagtggacaagagcaggtggcaggagggcaacgtgttctcctgttccgtgatgcacgaggccctgcacaatcactacacccagaagagcctctccctgtccctgggcaag

SEQ ID NO: 201 - DNA, 981 bp, Homo Sapiens
gccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 202 - DNA, 981 bp, Homo Sapiens
gcctccaccaagggcccatccgtcttccccctggcgccctgctccaggagcacctccgagagcacggccgccctgggctgcctggtcaaggactacttccccgaaccagtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccatgcccagcgcctccagttgcggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcatcgatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggatccttcttcctctacagcaggctaaccgtggacaagagcaggtggcaggaggggaatgtcttctcatgctccgtgatgcatgaggctctgcacaaccactacacacagaagagcctctccctgtctctgggtaaa

SEQ ID NO: 203 - protein, 327 aa, Homo Sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 204 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagtggagcccaaatcttgtgacaaaactcacacatgcccaccgtgcccagcacctgaactcgcgggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 205 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - DNA, 321 bp, Homo Sapiens
cgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 207 - protein, 107 aa, Homo Sapiens [sequence omitted]

SEQ ID NO: 208 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggagagcaaggacagcacctacagcctcagcagcaccctgacgctgagcaaagcagactacgagaaacacaaagtctacgccggcgaagtcacccatcagggcctgagctcgcccgtcacaaagagcttcaacaggggagagtgt

SEQ ID NO: 209 - protein, 107 aa, Homo Sapiens
RTVAAPSVFIFPPSDEQLKSGTASVVCLLNNFYPREAKVQWKVDNALQSGNSQESVTEQESKDSTYSLSSTLTLSKADYEKHKVYAGEVTHQGLSSPVTKSFNRGEC

SEQ ID NO: 210 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagcggaaggtggataacgccctccaatcgggtaactcccaggagagtgtcacagagcaggagagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 211 - protein, 107 aa, Homo Sapiens
RTVAAPSVFIFPPSDEQLKSGTASVVCLLNNFYPREAKVQRKVDNALQSGNSQESVTEQESKDSTYSLSSTLTLSKADYEKHKVYACEVTHQGLSSPVTKSFNRGEC

SEQ ID NO: 212 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgt

SEQ ID NO: 213 - protein, 107 aa, Homo Sapiens
RTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 214 - DNA, 321 bp, Homo Sapiens
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcaacaccctgacgctgagcaaagcagactacgagaaacacaaagtctacgcctgcgaagtcacccatcagggcctgagctcgcccgtcacaaagagcttcaacaggggagagtgc

SEQ ID NO: 215 - protein, 107 aa, Homo Sapiens
RTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 216 - DNA, 312 bp, Homo Sapiens
cccaaggccaaccccacggtcactctgttcccgccctcctctgaggagctccaagccaacaaggccacactagtgtgtctgatcagtgacttctacccgggagctgtgacagtggcttggaaggcagatggcagccccgtcaaggcgggagtggagacgaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 217 - protein, 104 aa, Homo Sapiens
PKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 218 - DNA, 318 bp, Homo Sapiens
ggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttca

SEQ ID NO: 219 - protein, 106 aa, Homo Sapiens
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 220 - DNA, 318 bp, Homo Sapiens; identical to SEQ ID NO: 218

SEQ ID NO: 221 - DNA, 318 bp, Homo Sapiens
ggccagcctaaggccgctccttctgtgaccctgttccccccatcctccgaggaactgcaggctaacaaggccaccctcgtgtgcctgatcagcgacttctaccctggcgccgtgaccgtggcctggaaggctgatagctctcctgtgaaggccggcgtggaaaccaccaccccttccaagcagtccaacaacaaatacgccgcctcctcctacctgtccctgacccctgagcagtggaagtcccaccggtcctacagctgccaagtgacccacgagggctccaccgtggaaaagaccgtggctcctaccgagtgctcc

SEQ ID NO: 222 - DNA, 318 bp, Homo Sapiens
ggccagcctaaagctgcccccagcgtcaccctgtttcctccctccagcgaggagctccaggccaacaaggccaccctcgtgtgcctgatctccgacttctatcccggcgctgtgaccgtggcttggaaagccgactccagccctgtcaaagccggcgtggagaccaccacaccctccaagcagtccaacaacaagtacgccgcctccagctatctctccctgacccctgagcagtggaagtcccaccggtcctactcctgtcaggtgacccacgagggctccaccgtggaaaagaccgtcgcccccaccgagtgctcc

SEQ ID NO: 223 - protein, 106 aa, Homo Sapiens; identical to SEQ ID NO: 219

SEQ ID NO: 224 - DNA, 318 bp, Homo Sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 225 - protein, 106 aa, Homo Sapiens
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 226 - DNA, 312 bp, Homo Sapiens
cccaaggctgccccctcggtcactctgttcccaccctcctctgaggagcttcaagccaacaaggccacactggtgtgtctcataagtgacttctacccgggagccgtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagttgcccctacggaatgttca

SEQ ID NO: 227 - protein, 104 aa, Homo Sapiens
PKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 228 - DNA, 318 bp, Homo Sapiens
ggtcagcccaaggctgccccctcggtcactctgttcccaccctcctctgaggagcttcaagccaacaaggccacactggtgtgtctcataagtgacttctacccggggccagtgacagttgcctggaaggcagatagcagccccgtcaaggcgggggtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacggaatgttca

SEQ ID NO: 229 - protein, 106 aa, Homo Sapiens
GQPKAAPSVTLFPPSSEELQANKATLVCLISDFYPGPVTVAWKADSSPVKAGVETTTPSKQSNNKYAASSYLSLTPEQWKSHKSYSCQVTHEGSTVEKTVAPTECS

SEQ ID NO: 230 - DNA, 318 bp, Homo Sapiens
ggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttca

SEQ ID NO: 231 - protein, 106 aa, Homo Sapiens
GQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 232 - DNA, 318 bp, Homo Sapiens
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctacctgagcctgacgcctgagcagtggaagtcccacagaagctacagctgccaggtcacgcatgaagggagcaccgtggagaagacagtggcccctacagaatgttca

SEQ ID NO: 233 - protein, 106 aa, Homo Sapiens; identical to SEQ ID NO: 225

SEQ ID NO: 234 - DNA, 318 bp, Homo Sapiens
ggtcagcccaaggctgccccatcggtcactctgttcccgccctcctctgaggagcttcaagccaacaaggccacactggtgtgcctgatcagtgacttctacccgggagctgtgaaagtggcctggaaggcagatggcagccccgtcaacacgggagtggagaccaccacaccctccaaacagagcaacaacaagtacgcggccagcagctacctgagcctgacgcctgagcagtggaagtcccacagaagctacagctgccaggtcacgcatgaagggagcaccgtggagaagacagtggcccctgcagaatgttca

SEQ ID NO: 235 - protein, 106 aa, Homo Sapiens
GQPKAAPSVTLFPPSSEELQANKATLVCLISDFYPGAVKVAWKADGSPVNTGVETTTPSKQSNNKYAASSYLSLTPEQWKSHRSYSCQVTHEGSTVEKTVAPAECS

SEQ ID NO: 236 - DNA, 318 bp, Homo Sapiens
ggtcagcccaaggctgccccatcggtcactctgttcccaccctcctctgaggagcttcaagccaacaaggccacactggtgtgtctcgtaagtgacttctacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 237 - protein, 106 aa, Homo Sapiens
GQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 238 - protein, 8 aa, Homo Sapiens
GFTFSDYY

SEQ ID NO: 239 - protein, 8 aa, Homo Sapiens
ISTSGSTI

SEQ ID NO: 240 - protein, 16 aa, Homo Sapiens
ARGITGTNFYHYGLGV

SEQ ID NO: 241 - protein, 5 aa, Homo Sapiens
DYYMS

SEQ ID NO: 242 - protein, 17 aa, Homo Sapiens
YISTSGSTIYYADSVKG

SEQ ID NO: 243 - protein, 14 aa, Homo Sapiens
GITGTNFYHYGLGV

SEQ ID NO: 244 - protein, 123 aa, Homo Sapiens
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSS

SEQ ID NO: 245 - DNA, 370 bp, Homo Sapiens
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcag

SEQ ID NO: 246 - protein, 453 aa, Homo Sapiens
QVQLVESGGGLVKPGGSLRLSCAASGFTFSDYYMSWIRQVPGKGLEWVSYISTSGSTIYYADSVKGRFTISRDNAKNSLYLQMNSLRAEDAAVYHCARGITGTNFYHYGLGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - DNA, 1359 bp, Homo Sapiens
caggtgcagctggtggagtctgggggaggcttggtcaagcctggagggtccctgagactctcctgtgcagcctctggattcaccttcagtgactactacatgagctggatccgccaggttccagggaaggggctggagtgggtttcatacattagtactagtggtagtaccatatactacgcagactctgtgaagggccgattcaccatctccagggacaacgccaagaactcactgtatctacaaatgaacagcctgagagccgaggacgcggccgtgtatcactgtgcgagaggtataactggaactaacttctaccactacggtttgggcgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 248 - protein, 6 aa, Homo Sapiens
QGINSW

SEQ ID NO: 249 - protein, 3 aa, Homo Sapiens
AAS

SEQ ID NO: 250 - protein, 9 aa, Homo Sapiens
QQVNSFPLT

SEQ ID NO: 251 - protein, 11 aa, Homo Sapiens
RASQGINSWLA

SEQ ID NO: 252 - protein, 7 aa, Homo Sapiens
AASTLQS

SEQ ID NO: 253 - protein, 9 aa, Homo Sapiens
QQVNSFPLT

SEQ ID NO: 254 - protein, 107 aa, Homo Sapiens
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIK

SEQ ID NO: 255 - DNA, 322 bp, Homo Sapiens
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaac

SEQ ID NO: 256 - protein, 214 aa, Homo Sapiens
DIQMTQSPSSVSASVGDRVTITCRASQGINSWLAWYQQKPGKAPKLLIYAASTLQSGVPSRFSGSGSGADFTLTISSLQPEDFATYYCQQVNSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - DNA, 642 bp, Homo Sapiens
gacatccagatgacccagtctccatcttccgtgtctgcatctgtaggagacagagtcaccatcacttgtcgggcgagtcagggtattaacagctggttagcctggtatcagcagaaaccagggaaagcccctaagctcctgatctatgctgcatccactttgcaaagtggggtcccatcaaggttcagcggcagtgggtctggggcagatttcactctcaccatcagcagcctgcagcctgaagattttgcaacttactattgtcaacaggttaacagtttcccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 258 - protein, 8 aa, Homo Sapiens
GFTFSYYA

SEQ ID NO: 259 - protein, 8 aa, Homo Sapiens
ISGGGGNT

SEQ ID NO: 260 - protein, 16 aa, Homo Sapiens
AKDRMKQLVRAYYFDY

SEQ ID NO: 261 - protein, 5 aa, Homo Sapiens
YYAMS

SEQ ID NO: 262 - protein, 17 aa, Homo Sapiens
TISGGGGNTHYADSVKG

SEQ ID NO: 263 - protein, 14 aa, Homo Sapiens
DRMKQLVRAYYFDY

SEQ ID NO: 264 - protein, 123 aa, Homo Sapiens
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSS

SEQ ID NO: 265 - DNA, 370 bp, Homo Sapiens
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcag

SEQ ID NO: 266 - protein, 453 aa, Homo Sapiens
EVPLVESGGGLVQPGGSLRLSCAASGFTFSYYAMSWVRQAPGKGLDWVSTISGGGGNTHYADSVKGRFTISRDNSKNTLYLHMNSLRAEDTAVYYCAKDRMKQLVRAYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 1359 bp, Homo Sapiens
gaggtgccgctggtggagtctgggggaggcttggtacagcctggggggtccctgagactctcctgtgcagcctctggattcacgtttagctactatgccatgagctgggtccgtcaggctccagggaaggggctggactgggtctcaactattagtggtggtggtggtaacacacactacgcagactccgtgaagggccgattcactatatccagagacaattccaagaacacgctgtatctgcacatgaacagcctgagagccgaagacacggccgtctattactgtgcgaaggatcggatgaaacagctcgtccgggcctactactttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 268 - protein, 6 aa, Homo Sapiens
QDISTY

SEQ ID NO: 269 - protein, 3 aa, Homo Sapiens
GTS

SEQ ID NO: 270 - protein, 9 aa, Homo Sapiens
QQLHTDPIT

SEQ ID NO: 271 - protein, 11 aa, Homo Sapiens
WASQDISTYLG

SEQ ID NO: 272 - protein, 7 aa, Homo Sapiens
GTSSLQS

SEQ ID NO: 273 - protein, 9 aa, Homo Sapiens
QQLHTDPIT

SEQ ID NO: 274 - protein, 107 aa, Homo Sapiens
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIK

SEQ ID NO: 275 - DNA, 322 bp, Homo Sapiens
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaac

SEQ ID NO: 276 - protein, 214 aa, Homo Sapiens
DIQLTQSPSFLSASVGDRVTITCWASQDISTYLGWYQQKPGKAPKLLIYGTSSLQSGVPSRFSGSGSGTEFTLTISSLQPEDFATYYCQQLHTDPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - DNA, 642 bp, Homo Sapiens
gacatccagttgacccagtctccatccttcctgtctgcatctgtaggagacagagtcaccatcacttgctgggccagtcaggacattagcacttatttaggctggtatcagcaaaaaccagggaaagcccctaagctcctgatctatggtacatccagtttgcaaagtggggtcccatcaaggttcagcggcagtggatctgggacagaattcactctcacaatcagcagcctgcagcctgaagattttgcaacttattactgtcaacagcttcatactgacccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 278 - protein, 8 aa, Homo Sapiens
GFTFSSYW

SEQ ID NO: 279 - protein, 8 aa, Homo Sapiens
IKQDGSEK

SEQ ID NO: 280 - protein, 12 aa, Homo Sapiens
ARVRQWSDYSDY

SEQ ID NO: 281 - protein, 5 aa, Homo Sapiens
SYWMN

SEQ ID NO: 282 - protein, 17 aa, Homo Sapiens
NIKQDGSEKYYVDSVKG

SEQ ID NO: 283 - protein, 10 aa, Homo Sapiens
VRQWSDYSDY

SEQ ID NO: 284 - protein, 119 aa, Homo Sapiens
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSS

SEQ ID NO: 285 - DNA, 358 bp, Homo Sapiens
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcag

SEQ ID NO: 286 - protein, 449 aa, Homo Sapiens
EVHLVESGGGLVQPGGSLRLSCAASGFTFSSYWMNWVRQAPGKGLEWVANIKQDGSEKYYVDSVKGRFTVSRDNAKNSLYLQMNSLRAEDTAVYYCARVRQWSDYSDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - DNA, 1347 bp, Homo Sapiens
gaggtgcacctggtggagtctgggggaggcttggtccagcctggggggtccctgagactctcctgtgcagcctctggattcacctttagtagctattggatgaactgggtccgccaggctccagggaaggggctggagtgggtggccaacataaagcaagatggaagtgagaaatactatgtggactctgtgaagggccgcttcaccgtctccagagacaacgccaagaactcactgtatctgcaaatgaacagcctgagagccgaggacacggctgtgtattactgtgcgagagttcgacaatggtccgactactctgactactggggccagggaaccccggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaag

SEQ ID NO: 288 - protein, 6 aa, Homo Sapiens
QGISSW

SEQ ID NO: 289 - protein, 3 aa, Homo Sapiens
AAS

SEQ ID NO: 290 - protein, 9 aa, Homo Sapiens
QQANSFPFT

SEQ ID NO: 291 - protein, 11 aa, Homo Sapiens
RASQGISSWLA

SEQ ID NO: 292 - protein, 7 aa, Homo Sapiens
AASSLQS

SEQ ID NO: 293 - protein, 9 aa, Homo Sapiens
QQANSFPFT

SEQ ID NO: 294 - protein, 107 aa, Homo Sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIK

SEQ ID NO: 295 - DNA, 322 bp, Homo Sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaac

SEQ ID NO: 296 - protein, 214 aa, Homo Sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 297 - DNA, 642 bp, Homo Sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 298 - protein, 214 aa, Homo Sapiens
DIQMTQSPSSLSASVGDRVTITCRASQSISSYLNWYQQKPGKAPKLLIYYASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 453 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 347 aa, Homo Sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 301 - protein, 133 aa, Homo Sapiens [sequence omitted]

SEQ ID NO: 302 - protein, 586 aa, Homo Sapiens
EVQLVESGGGLVQPGRSLRLSCAASGFTFDDYAMHWVRQVPGKGLEWVSGISWIRTGIGYADSVKGRFTIFRDNAKNSLYLQMNSLRAEDTALYYCAKDMKGSGTYGGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 303 - protein, 14 aa, Homo Sapiens
APTSTQLQLELLLD

SEQ ID NO: 304 - protein, 11 aa, Homo Sapiens
TQLQLEHLLLD

SEQ ID NO: 305 - protein, 17 aa, Homo Sapiens
APTSKKTQLQLEHLLLD

SEQ ID NO: 306 - protein, 19 aa, Homo Sapiens
PTSSSTKKTQLQLEHLLLD

SEQ ID NO: 307 - protein, 18 aa, Homo Sapiens
TSSSTKKTQLQLEHLLLD

SEQ ID NO: 308 - protein, 17 aa, Homo Sapiens
SSSTKKTQLQLEHLLLD

SEQ ID NO: 309 - protein, 16 aa, Homo Sapiens
SSTKKTQLQLEHLLLD

SEQ ID NO: 310 - protein, 15 aa, Homo Sapiens
STKKTQLQLEHLLLD

SEQ ID NO: 311 - protein, 14 aa, Homo Sapiens
TKKTQLQLEHLLLD

SEQ ID NO: 312 - protein, 13 aa, Homo Sapiens
KKTQLQLEHLLLD

SEQ ID NO: 313 - protein, 12 aa, Homo Sapiens
KTQLQLEHLLLD

SEQ ID NO: 314 - protein, 19 aa, Homo Sapiens
APTSSSTKTQLQLEHLLLD

SEQ ID NO: 315 - protein, 18 aa, Homo Sapiens
APTSSSTTQLQLEHLLLD

SEQ ID NO: 316 - protein, 17 aa, Homo Sapiens
APTSSSTQLQLEHLLLD

SEQ ID NO: 317 - protein, 16 aa, Homo Sapiens
APTSSTQLQLEHLLLD

SEQ ID NO: 318 - protein, 14 aa, Homo Sapiens
APTTQLQLEHLLLD

SEQ ID NO: 319 - protein, 13 aa, Homo Sapiens
APTQLQLEHLLLD

SEQ ID NO: 320 - protein, 12 aa, Homo Sapiens
ATQLQLEHLLLD

SEQ ID NO: 321 - protein, 15 aa, Homo Sapiens
ATKKTQLQLEHLLLD

SEQ ID NO: 322 - protein, 15 aa, Homo Sapiens
APKKTQLQLEHLLLD

SEQ ID NO: 323 - protein, 15 aa, Homo Sapiens
APTKTQLQLEHLLLD

SEQ ID NO: 324 - protein, 113 aa, Homo Sapiens
LQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 325 - protein, 290 aa, Mus Musculus
MRIFAGIIFTACCHLLRAFTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHWVLLGSILLFLIVVSTVLLFLRKQVRMLDVEKCGVEDTSSKNRNDTQFEET

SEQ ID NO: 326 - protein, 226 aa, Mus Musculus
FTITAPKDLYVVEYGSNVTMECRFPVERELDLLALVVYWEKEDEQVIQFVAGEEDLKPQHSNFRGRASLPKDQLLKGNAALQITDVKLQDAGVYCCIISYGGADYKRITLKVNAPYRKINQRISVDPATSEHELICQAEGYPEAEVIWTNSDHQPVSGKRSVTTSRTEGMLLNVTSSLRVNATANDVFYCTFWRSQPGQNHTAELIIPELPATHPPQNRTHHHHHH

SEQ ID NO: 327 - protein, 251 aa, Homo Sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 328 - protein, 525 aa, Homo Sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 329 - protein, 347 aa, Homo Sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 330 - protein, 152 aa, Homo Sapiens
DCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 331 - protein, 133 aa, Homo Sapiens
GIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 332 - protein, 133 aa, Homo Sapiens [sequence omitted]

SEQ ID NO: 333 - protein, 127 aa, Homo Sapiens [sequence omitted]

SEQ ID NO: 334 - protein, 171 aa, Homo Sapiens
CDLPQNHGLLSRNTLVLLHQMRRISPFLCLKDRRDFRFPQEMVKGSQLQKAHVMSVLHEMLQQIFSLFHTERSSAAWNMTLLDQLHTELHQQLQHLETCLLQVVGEGESAGAISSPALTLRRYFQGIRVYLKEKKYSDCAWEVVRMEIMKSLFLSTNMQERLRSKDRDLGS

SEQ ID NO: 335 - protein, 177 aa, Homo Sapiens
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 336 - protein, 197 aa, Homo Sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 337 - protein, 306 aa, Homo Sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 338 - protein, 103 aa, Homo Sapiens
TPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 339 - protein, 77 aa, Homo Sapiens
VPLSRTVRCTCISISNQPVNPRSLEKLEIIPASQFCPRVEIIATMKKKGEKRCLNPESKAIKNLLKAVSKERSKRSP

SEQ ID NO: 340 - protein, 330 aa, Homo Sapiens [sequence omitted]

SEQ ID NO: 341 - DNA, 996 bp, Homo Sapiens
gccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 342 - protein, 450 aa, Homo Sapiens
EVQLVESGGGLVQPGRSLRLSCAASGFTFDDYAMHWVRQAPGKGLEWVSGISWIRTGIGYADSVKGRFTISRDNAKNSLYLQMNSLRAEDTALYYCAKDMKGSGTYGGWFDTWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPELAGAPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 343 - protein, 8 aa, Homo Sapiens
GFTFSNYA

SEQ ID NO: 344 - protein, 8 aa, Homo Sapiens
ISFSGGTT

SEQ ID NO: 345 - protein, 14 aa, Homo Sapiens
AKDEAPAGATFFDS

SEQ ID NO: 346 - protein, 5 aa, Homo Sapiens
NYAMS

SEQ ID NO: 347 - protein, 17 aa, Homo Sapiens
AISFSGGTTYYADSVKG

SEQ ID NO: 348 - protein, 12 aa, Homo Sapiens
DEAPAGATFFDS

SEQ ID NO: 349 - protein, 121 aa, Homo Sapiens
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSS

SEQ ID NO: 350 - DNA, 364 bp, Homo Sapiens
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcag

SEQ ID NO: 351 - protein, 448 aa, Homo Sapiens
EVQLAESGGGLVQPGGSLRLSCAASGFTFSNYAMSWVRQTPGKGLEWVSAISFSGGTTYYADSVKGRFTISRDNSKNTLYLHMNSLRADDTAVYYCAKDEAPAGATFFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 352 - DNA, 1344 bp, Homo Sapiens
gaagtgcaactggcggagtctgggggaggcttggtacagccgggggggtccctgagactctcctgtgcagcctctggattcacctttagcaactatgccatgagttgggtccgccagactccaggaaaggggctggagtgggtctcagctattagttttagtggtggtactacatactacgctgactccgtgaagggccggttcaccatctccagagacaattccaagaacacgctgtatttgcacatgaacagcctgagagccgatgacacggccgtatattactgtgcgaaagatgaggcaccagctggcgcaaccttctttgactcctggggccagggaacgctggtcaccgtctcctcagccagcaccaagggcccttccgtgttccccctggccccttgcagcaggagcacctccgaatccacagctgccctgggctgtctggtgaaggactactttcccgagcccgtgaccgtgagctggaacagcggcgctctgacatccggcgtccacacctttcctgccgtcctgcagtcctccggcctctactccctgtcctccgtggtgaccgtgcctagctcctccctcggcaccaagacctacacctgtaacgtggaccacaaaccctccaacaccaaggtggacaaacgggtcgagagcaagtacggccctccctgccctccttgtcctgcccccgagttcgaaggcggacccagcgtgttcctgttccctcctaagcccaaggacaccctcatgatcagccggacacccgaggtgacctgcgtggtggtggatgtgagccaggaggaccctgaggtccagttcaactggtatgtggatggcgtggaggtgcacaacgccaagacaaagccccgggaagagcagttcaactccacctacagggtggtcagcgtgctgaccgtgctgcatcaggactggctgaacggcaaggagtacaagtgcaaggtcagcaataagggactgcccagcagcatcgagaagaccatctccaaggctaaaggccagccccgggaacctcaggtgtacaccctgcctcccagccaggaggagatgaccaagaaccaggtgagcctgacctgcctggtgaagggattctacccttccgacatcgccgtggagtgggagtccaacggccagcccgagaacaattataagaccacccctcccgtcctcgacagcgacggatccttctttctgtactccaggctgaccgtggataagtccaggtggcaggaaggcaacgtgttcagctgctccgtgatgcacgaggccctgcacaatcactacacccagaagtccctgagcctgtccctgggaaag

SEQ ID NO: 353 - protein, 6 aa, Homo Sapiens
QGIRRW

SEQ ID NO: 354 - protein, 3 aa, Homo Sapiens
GAS

SEQ ID NO: 355 - protein, 9 aa, Homo Sapiens
QQANSFPIT

SEQ ID NO: 356 - protein, 11 aa, Homo Sapiens
RASQGIRRWLA

SEQ ID NO: 357 - protein, 7 aa, Homo Sapiens
GASSLQS

SEQ ID NO: 358 - protein, 9 aa, Homo Sapiens
QQANSFPIT

SEQ ID NO: 359 - protein, 107 aa, Homo Sapiens
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIK

SEQ ID NO: 360 - DNA, 322 bp, Homo Sapiens
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaac

SEQ ID NO: 361 - protein, 214 aa, Homo Sapiens
DIQMTQSPSSVSASVGDRVTITCRASQGIRRWLAWYQQKPGKAPKLLISGASSLQSGVPSRFSGSGSGTDFTLIITSLQPEDFATYYCQQANSFPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 362 - DNA, 642 bp, Homo Sapiens
gacatccagatgacccagtctccatcttccgtgtctgcatctgtaggagacagagtcaccatcacttgtcgggcgagtcagggtattaggaggtggttagcctggtatcagcagaaaccagggaaagcccctaaactcctgatctctggtgcatccagtttgcaaagtggggtcccatcaaggttcagcggcagtggatctgggacagatttcactctcatcattaccagtctgcagcctgaagattttgcaacttactattgtcaacaggctaacagtttcccgatcaccttcggccaagggacacgactggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 363 - protein, 8 aa, Homo Sapiens
GYTFSTFG

SEQ ID NO: 364 - protein, 8 aa, Homo Sapiens
ISAYNGDT

SEQ ID NO: 365 - protein, 14 aa, Homo Sapiens
ARSSGHYYYYGMDV

SEQ ID NO: 366 - protein, 121 aa, Homo Sapiens
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSS

SEQ ID NO: 367 - DNA, 363 bp, Homo Sapiens
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctca

SEQ ID NO: 368 - protein, 451 aa, Homo Sapiens
QVQVVQSGAEVKKPGASVKVSCKASGYTFSTFGITWVRQAPGQGLEWMGWISAYNGDTNYAQNLQGRVIMTTDTSTSTAYMELRSLRSDDTAVYYCARSSGHYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - DNA, 1359 bp, Homo Sapiens
caggttcaggtggtgcagtctggagctgaggtgaagaagcctggggcctcagtgaaggtctcctgcaaggcttctggttacaccttttccacctttggtatcacctgggtgcgacaggcccctggacaagggcttgaatggatgggatggatcagcgcttacaatggtgacacaaactatgcacagaatctccagggcagagtcatcatgaccacagacacatccacgagcacagcctacatggagctgaggagcctgagatctgacgacacggccgtttattactgtgcgaggagcagtggccactactactactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 370 - protein, 11 aa, Homo Sapiens
QSLLHSNEYNY

SEQ ID NO: 371 - protein, 3 aa, Homo Sapiens
LGS

SEQ ID NO: 372 - protein, 9 aa, Homo Sapiens
MQSLQTPLT

SEQ ID NO: 373 - protein, 112 aa, Homo Sapiens
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIK

SEQ ID NO: 374 - DNA, 336 bp, Homo Sapiens
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaa

SEQ ID NO: 375 - protein, 219 aa, Homo Sapiens
DIVMTQSPLSLPVTPGEPASISCRSSQSLLHSNEYNYLDWYLQKPGQSPQLLIFLGSNRASGVPDRFSGSGSGTDFTLKITRVEAEDVGIYYCMQSLQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - DNA, 657 bp, Homo Sapiens
gatattgtgatgactcagtctccactctccctgcccgtcacccctggagagccggcctccatctcctgcaggtctagtcagagcctcctgcatagtaatgaatacaactatttggattggtacctgcagaagccagggcagtctccacagctcctgatctttttgggttctaatcgggcctccggggtccctgacaggttcagtggcagtggatcaggcacagattttacactgaaaatcaccagagtggaggctgaggatgttggaatttattactgcatgcaatctctacaaactccgctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 377 - protein, 8 aa, Homo Sapiens
GYTFTSYG

SEQ ID NO: 378 - protein, 8 aa, Homo Sapiens
ISAYNGNT

SEQ ID NO: 379 - protein, 17 aa, Homo Sapiens
ARSTYFYGSGTLYGMDV

SEQ ID NO: 380 - protein, 124 aa, Homo Sapiens
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSS

SEQ ID NO: 381 - DNA, 372 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctca

SEQ ID NO: 382 - protein, 454 aa, Homo Sapiens
QVQLVQSGGEVKKPGASVKVSCKASGYTFTSYGFSWVRQAPGQGLEWMGWISAYNGNTNYAQKLQGRVTMTTDTSTSTAYMELRSLRSDDTAVYYCARSTYFYGSGTLYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - DNA, 1368 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtcaccatgaccacagacacatccacgagcacagcctacatggagctgaggagcttgagatctgacgacacggccgtgtattactgtgcgagatctacgtatttctatggttcggggaccctctacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 384 - protein, 11 aa, Homo Sapiens
QSLLHSDGYNY

SEQ ID NO: 385 - protein, 3 aa, Homo Sapiens
LGS

SEQ ID NO: 386 - protein, 9 aa, Homo Sapiens
MQALQTPLS

SEQ ID NO: 387 - protein, 112 aa, Homo Sapiens
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIK

SEQ ID NO: 388 - DNA, 336 bp, Homo Sapiens
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaa

SEQ ID NO: 389 - protein, 219 aa, Homo Sapiens
DIVMTQSPLSLPVTPGEPASISCRSSQSLLHSDGYNYLDWYLQKPGQSPQLLIYLGSTRASGFPDRFSGSGSGTDFTLKISRVEAEDVGVYYCMQALQTPLSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 390 - DNA, 657 bp, Homo Sapiens
gatattgtgatgactcagtctccactctccctgcccgtcacccctggagagccggcctccatctcctgcaggtctagtcagagcctcctgcatagtgatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 391 - protein, 8 aa, Homo Sapiens
GYTFTSYG

SEQ ID NO: 392 - protein, 8 aa, Homo Sapiens
ISAYNGNT

SEQ ID NO: 393 - protein, 17 aa, Homo Sapiens
ARSTYFYGSGTLYGMDV

SEQ ID NO: 394 - protein, 124 aa, Homo Sapiens; identical to SEQ ID NO: 380

SEQ ID NO: 395 - DNA, 372 bp, Homo Sapiens; identical to SEQ ID NO: 381

SEQ ID NO: 396 - protein, 454 aa, Homo Sapiens; identical to SEQ ID NO: 382

SEQ ID NO: 397 - DNA, 1368 bp, Homo Sapiens; identical to SEQ ID NO: 383

SEQ ID NO: 398 - protein, 11 aa, Homo Sapiens
QSLLHSDGYNC

SEQ ID NO: 399 - protein, 3 aa, Homo Sapiens
LGS

SEQ ID NO: 400 - protein, 9 aa, Homo Sapiens
MQALQTPCS

SEQ ID NO: 401 - protein, 112 aa, Homo Sapiens
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIK

SEQ ID NO: 402 - DNA, 336 bp, Homo Sapiens; identical to SEQ ID NO: 388

SEQ ID NO: 403 - protein, 219 aa, Homo Sapiens
DIVMTQSPLSLPVTPGEPASISCRSSQSLLHSDGYNCLDWYLQKPGQSPQLLIYLGSTRASGFPDRFSGSGSGTDFTLKISRVEAEDVGVYYCMQALQTPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 657 bp, Homo Sapiens; identical to SEQ ID NO: 390

SEQ ID NO: 405 - protein, 8 aa, Homo Sapiens
GVTFDDYG

SEQ ID NO: 406 - protein, 8 aa, Homo Sapiens
INWNGGDT

SEQ ID NO: 407 - protein, 17 aa, Homo Sapiens
ARDFYGSGSYYHVPFDY

SEQ ID NO: 408 - protein, 124 aa, Homo Sapiens
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSS

SEQ ID NO: 409 - DNA, 372 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 410 - protein, 454 aa, Homo Sapiens
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - DNA, 1368 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggartgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 412 - protein, 7 aa, Homo Sapiens
QSVSRSY

SEQ ID NO: 413 - protein, 3 aa, Homo Sapiens
GAS

SEQ ID NO: 414 - protein, 9 aa, Homo Sapiens
HQYDMSPFT

SEQ ID NO: 415 - protein, 108 aa, Homo Sapiens
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIK

SEQ ID NO: 416 - DNA, 324 bp, Homo Sapiens
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaa

SEQ ID NO: 417 - protein, 215 aa, Homo Sapiens
EIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - DNA, 645 bp, Homo Sapiens
gaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 419 - protein, 8 aa, Homo Sapiens
GLTFDDYG

SEQ ID NO: 420 - protein, 8 aa, Homo Sapiens
INWNGDNT

SEQ ID NO: 421 - protein, 17 aa, Homo Sapiens
ARDYYGSGSYYNVPFDY

SEQ ID NO: 422 - protein, 124 aa, Homo Sapiens
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSS

SEQ ID NO: 423 - DNA, 372 bp, Homo Sapiens
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctca

SEQ ID NO: 424 - protein, 454 aa, Homo Sapiens
EVQLVESGGGVVRPGGSLRLSCAASGLTFDDYGMSWVRQVPGKGLEWVSGINWNGDNTDYADSVKGRFTISRDNAKNSLYLQMNSLRAEDTALYYCARDYYGSGSYYNVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 425 - DNA, 1368 bp, Homo Sapiens
gaggtgcagctggtggagtctgggggaggtgtggtacggcctggggggtccctgagactctcctgtgcagcctctggactcacctttgatgattatggcatgagctgggtccgccaagttccagggaaggggctggagtgggtctctggtattaattggaatggtgataacacagattatgcagactctgtgaagggccgattcaccatctccagagacaacgccaagaactccctgtatctgcaaatgaacagtctgagagccgaggacacggccttgtattactgtgcgagggattactatggttcggggagttattataacgttccttttgactactggggccagggaaccctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 426 - protein, 7 aa, Homo Sapiens
QSVSSSY

SEQ ID NO: 427 - protein, 3 aa, Homo Sapiens
GAS

SEQ ID NO: 428 - protein, 8 aa, Homo Sapiens
QQYGSSPF

SEQ ID NO: 429 - protein, 107 aa, Homo Sapiens
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIK

SEQ ID NO: 430 - DNA, 321 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaa

SEQ ID NO: 431 - DNA, 323 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaa

SEQ ID NO: 432 - protein, 214 aa, Homo Sapiens
EIVLTQSPGTLSLSPGERATLSCRASQSVSSSYLAWYQQKPGQAPRLLIYGASSRATGIPDRFSGSGSGTDFTLTIRRLEPEDFAVYYCQQYGSSPFFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 433 - DNA, 642 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 434 - DNA, 644 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatatatggtgcatccagcagggccactggcatcccagacaggttcagtggcagtgggtctgggacagacttcactctcaccatcagaagactggagcctgaagattttgcagtgtattactgtcagcagtatggtagttcaccattcacttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 435 - protein, 8 aa, Homo Sapiens
GYTFNSYG

SEQ ID NO: 436 - protein, 8 aa, Homo Sapiens
ISVHNGNT

SEQ ID NO: 437 - protein, 17 aa, Homo Sapiens
ARAGYDILTDFSDAFDI

SEQ ID NO: 438 - protein, 124 aa, Homo Sapiens
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSS

SEQ ID NO: 439 - DNA, 372 bp, Homo Sapiens
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttca

SEQ ID NO: 440 - protein, 454 aa, Homo Sapiens
QVQLVQSGAEVKKPGASVKVSCKASGYTFNSYGIIWVRQAPGQGLEWMGWISVHNGNTNCAQKLQGRVTMTTDTSTSTAYMELRSLRTDDTAVYYCARAGYDILTDFSDAFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 441 - DNA, 1368 bp, Homo Sapiens
caggttcagttggtgcagtctggagctgaggtgaagaagcctggggcctcagtgaaggtctcctgcaaggcttctggttacacctttaatagttatggtatcatctgggtgcgacaggcccctggacaagggcttgagtggatgggatggatcagcgttcacaatggtaacacaaactgtgcacagaagctccagggtagagtcaccatgaccacagacacatccacgagcacagcctacatggagctgaggagcctgagaactgacgacacggccgtgtattactgtgcgagagcgggttacgatattttgactgatttttccgatgcttttgatatctggggccacgggacaatggtcaccgtctcttcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 442 - protein, 6 aa, Homo Sapiens
QNINNF

SEQ ID NO: 443 - protein, 3 aa, Homo Sapiens
AAS

SEQ ID NO: 444 - protein, 8 aa, Homo Sapiens
QQSYGIPW

SEQ ID NO: 445 - protein, 106 aa, Homo Sapiens
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIK

SEQ ID NO: 446 - DNA, 318 bp, Homo Sapiens
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaa

SEQ ID NO: 447 - protein, 213 aa, Homo Sapiens
DIQMTQSPSSLSASVGDRVTITCRASQNINNFLNWYQQKEGKGPKLLIYAASSLQRGIPSTFSGSGSGTDFTLTISSLQPEDFATYICQQSYGIPWVGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - DNA, 639 bp, Homo Sapiens
gacatccagatgacccagtctccatcctccctgtctgcatctgtaggagacagagtcaccatcacttgccgggcaagtcagaacattaataactttttaaattggtatcagcagaaagaagggaaaggccctaagctcctgatctatgcagcatccagtttgcaaagagggataccatcaacgttcagtggcagtggatctgggacagacttcactctcaccatcagcagtctgcaacctgaagattttgcaacttacatctgtcaacagagctacggtatcccgtgggtcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 449 - protein, 8 aa, Homo Sapiens
GFTFSDYF

SEQ ID NO: 450 - protein, 8 aa, Homo Sapiens
ISSSGSTI

SEQ ID NO: 451 - protein, 21 aa, Homo Sapiens
ARDHYDGSGIYPLYYYYGLDV

SEQ ID NO: 452 - protein, 128 aa, Homo Sapiens
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSS

SEQ ID NO: 453 - DNA, 384 bp, Homo Sapiens
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctca

SEQ ID NO: 454 - protein, 458 aa, Homo Sapiens
QVQLVESGGGLVKPGGSLRLSCAASGFTFSDYFMSWIRQAPGKGLEWISYISSSGSTIYYADSVRGRFTISRDNAKYSLYLQMNSLRSEDTAVYYCARDHYDGSGIYPLYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1380 bp, Homo Sapiens
caggtgcagctggtggagtctgggggaggcttggtcaagcctggagggtccctgagactctcctgtgcagcctctggattcaccttcagtgactacttcatgagctggatccgccaggcgccagggaaggggctggagtggatttcatacattagttctagtggtagtaccatatactacgcagactctgtgaggggccgattcaccatctccagggacaacgccaagtactcactgtatctgcaaatgaacagcctgagatccgaggacacggccgtgtattactgtgcgagagatcactacgatggttcggggatttatcccctctactactattacggtttggacgtctggggccaggggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 456 - protein, 11 aa, Homo Sapiens
QSLLHSNGYNY

SEQ ID NO: 457 - protein, 3 aa, Homo Sapiens
LGS

SEQ ID NO: 458 - protein, 9 aa, Homo Sapiens
MQALQTPRS

SEQ ID NO: 459 - protein, 111 aa, Homo Sapiens
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIK

SEQ ID NO: 460 - DNA, 333 bp, Homo Sapiens
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaa

SEQ ID NO: 461 - protein, 218 aa, Homo Sapiens
IVMTQSPLSLPVTPGEPASISCRSSQSLLHSNGYNYLDYYLQKPGQSPQLLIYLGSYRASGVPDRFSGSGSGTDFTLKISRVEAEDVGVYYCMQALQTPRSFGQGTTLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 462 - DNA, 654 bp, Homo Sapiens
attgtgatgactcagtctccactctccctacccgtcacccctggagagccggcctccatctcctgcaggtctagtcagagcctcctgcatagtaatggatacaactatttggattattacctgcagaagccagggcagtctccacagctcctgatctatttgggttcttatcgggcctccggggtccctgacaggttcagtggcagtggatcaggcacagattttacactgaaaatcagcagagtggaggctgaggatgttggggtttattactgcatgcaagctctacaaactcctcgcagttttggccaggggaccacgctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 463 - protein, 10 aa, Homo Sapiens
GFSLSTTGVG

SEQ ID NO: 464 - protein, 7 aa, Homo Sapiens
IYWDDDK

SEQ ID NO: 465 - protein, 16 aa, Homo Sapiens
THGYGSASYYHYGMDV

SEQ ID NO: 466 - protein, 124 aa, Homo Sapiens
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 467 - DNA, 372 bp, Homo Sapiens
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 468 - protein, 454 aa, Homo Sapiens
QITLKESGPTLVKPTQTLTLTCTFSGFSLSTTGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 469 - DNA, 1368 bp, Homo Sapiens
cagatcaccttgaaggagtctggtcctacgctggtgaaacccacacagaccctcacgctgacctgcaccttctctgggttctcactcagcactactggagtgggtgtgggctggatccgtcagcccccaggaaaggccctggagtggcttgcagtcatttattgggatgatgataagcgctacagcccatctctgaagagcagactcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 470 - protein, 6 aa, Homo Sapiens
QSVTNY

SEQ ID NO: 471 - protein, 3 aa, Homo Sapiens
DAS

SEQ ID NO: 472 - protein, 9 aa, Homo Sapiens
QHRSNWPLT

SEQ ID NO: 473 - protein, 107 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIK

SEQ ID NO: 474 - DNA, 322 bp, Homo Sapiens
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaac

SEQ ID NO: 475 - protein, 214 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQHRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 476 - DNA, 643 bp, Homo Sapiens
gaaattgtattgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctctcactttcggcggagggaccaaggtggagatcaaaccgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 477 - protein, 10 aa, Homo Sapiens
GFSLSTSGVG

SEQ ID NO: 478 - protein, 7 aa, Homo Sapiens
IYWDDDK

SEQ ID NO: 479 - protein, 16 aa, Homo Sapiens
THGYGSASYYHYGMDV

SEQ ID NO: 480 - protein, 124 aa, Homo Sapiens
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSS

SEQ ID NO: 481 - DNA, 372 bp, Homo Sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctca

SEQ ID NO: 482 - protein, 454 aa, Homo Sapiens
QITLKESGPTLVKPTQTLTLTCTFSGFSLSTSGVGVGWIRQPPGKALEWLAVIYWDDDKRYSPSLKSRLTITKDTSKNQVVLTMTNMDPVDTATYFCTHGYGSASYYHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - DNA, 1368 bp, Homo Sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacggatatggttcggcgagttattaccactacggtatggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 484 - protein, 6 aa, Homo Sapiens
QSVTNY

SEQ ID NO: 485 - protein, 3 aa, Homo Sapiens
DAS

SEQ ID NO: 486 - protein, 9 aa, Homo Sapiens
QQRSNWPLT

SEQ ID NO: 487 - protein, 107 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIK

SEQ ID NO: 488 - DNA, 321 bp, Homo Sapiens
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaa

SEQ ID NO: 489 - protein, 214 aa, Homo Sapiens
EIVLTQSPATLSLSPGERATLSCRASQSVTNYLAWHQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - DNA, 642 bp, Homo Sapiens
gaaattgtgttgacacagtctccagccaccctgtctttgtctccaggggaaagagccaccctctcctgcagggccagtcagagtgttaccaactacttagcctggcaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 491 - protein, 8 aa, Homo Sapiens
GFTFSDYY

SEQ ID NO: 492 - protein, 8 aa, Homo Sapiens
ISSSGSTI

SEQ ID NO: 493 - protein, 20 aa, Homo Sapiens
ARDFYDILTDSPYFYYGVDV

SEQ ID NO: 494 - protein, 127 aa, Homo Sapiens
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSS

SEQ ID NO: 495 - DNA, 381 bp, Homo Sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctca

SEQ ID NO: 496 - protein, 457 aa, Homo Sapiens
QVQLVESGGGLVKPGGSLRLSCAASGFTFSDYYMSWIRQAPGKGLEWVSYISSSGSTIYYADSVKGRFTISRDNAKNSLYLQINSLRAEDTAVYYCARDFYDILTDSPYFYYGVDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 497 - DNA, 1377 bp, Homo Sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaattaacagcctgagagccgaggacacggccgtgtattactgtgcgagagatttttacgatattttgactgatagtccgtacttctactacggtgtggacgtctggggccaagggaccacggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 498 - protein, 11 aa, Homo Sapiens
QSLLHSNGYNY

SEQ ID NO: 499 - protein, 3 aa, Homo Sapiens
LGS

SEQ ID NO: 500 - protein, 9 aa, Homo Sapiens
MQALQTPRT

SEQ ID NO: 501 - protein, 112 aa, Homo Sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 502 - DNA, 336 bp, Homo Sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaa

SEQ ID NO: 503 - protein, 219 aa, Homo Sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - DNA, 657 bp, Homo Sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacgttcggccaagggaccaaggtggaaatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 505 - protein, 239 aa, Homo Sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTIEGRDYKDDDDKHHHHHH

SEQ ID NO: 506 - protein, 179 aa, Homo Sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 507 - protein, 121 aa, Homo Sapiens
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKF

SEQ ID NO: 508 - protein, 199 aa, Homo Sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 509 - protein, 33 aa, Homo Sapiens
KYSSSVHDPNGEYMFMRAVNTAKKSRLTDVTLM

SEQ ID NO: 510 - protein, 128 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 511 - protein, 121 aa, Mus Musculus
EINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLK

SEQ ID NO: 512 - protein, 147 aa, Mus Musculus
MGWSCIILFLVATATGVHSEINGSADHRMFSFHNGGVQISCKYPETVQQLKMRLFREREVLCELTKTKGSGNAVSIKNPMLCLYHLSNNSVSFFLNNPDSSQGSYYFCSLSIFDPPPFQERNLSGGYLHIYESQLCCQLKIVVQVTE

SEQ ID NO: 513 - protein, 199 aa, Cynomologus
MKSGLWYFFLFCLHMKVLTGEINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLKFWLPIGCATFVVVCIFGCILICWLTKKKYSSTVHDPNGEYMFMRAVNTAKKSRLTGTTP

SEQ ID NO: 514 - protein, 120 aa, Cynomologus
EINGSANYEMFIFHNGGVQILCKYPDIVQQFKMQLLKGGQILCDLTKTKGSGNKVSIKSLKFCHSQLSNNSVSFFLYNLDRSHANYYFCNLSIFDPPPFKVTLTGGYLHIYESQLCCQLK

SEQ ID NO: 515 - protein, 240 aa, Homo Sapiens
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWS

SEQ ID NO: 516 - protein, 302 aa, Homo Sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 517 - protein, 113 aa, Homo Sapiens
LQMILNGINNYKNPKLTAMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 518 - protein, 113 aa, Homo Sapiens
LQMILNGINNYKNPKLTQMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 519 - DNA, 336 bp, Homo Sapiens
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaa

SEQ ID NO: 520 - DNA, 657 bp, Homo Sapiens
gatattgtgatgactcagtctccactctccctgcccgtcacccctggagagccggcctccatctcctgcaggtctagtcagagcctcctgcatagtgatggatacaactatttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgctcagttttggccaggggaccaagctggagatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 521 - DNA, 372 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctca

SEQ ID NO: 522 - DNA, 1368 bp, Homo Sapiens
gaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgacagtggacaagtcccggtggcagcagggcaacgtgttctcctgctccgtgatgcacgaggccctgcacaaccactacacccagaagtccctgtccctgagccccggcaagtgatga

SEQ ID NO: 523 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtccccgggtaaa

SEQ ID NO: 524 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 525 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacatcttctcatgctccgtgatgcatgaggctctgcacaaccactacacgcagaagagcctctccctgtctccgggtaaa

SEQ ID NO: 526 - protein, 330 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNIFSCSVMHEALHNHYTQKSLSLSPGK

SEQ ID NO: 527 - DNA, 978 bp, Homo Sapiens
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 528 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 529 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgacctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 530 - protein, 326 aa, Homo Sapiens
ASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 531 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcagcttgggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 532 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 533 - DNA, 978 bp, Homo Sapiens
gcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccggctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatctccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaa

SEQ ID NO: 534 - protein, 326 aa, Homo Sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 535 - DNA, 318 bp, Homo Sapiens
ggtcagcccaaggctgccccctcggtcactctgttcccaccctcctctgaggagcttcaagccaacaaggccacactggtgtgtctcgtaagtgacttcaacccgggagccgtgacagtggcctggaaggcagatggcagccccgtcaaggtgggagtggagaccaccaaaccctccaaacaaagcaacaacaagtatgcggccagcagctacctgagcctgacgcccgagcagtggaagtcccacagaagctacagctgccgggtcacgcatgaagggagcaccgtggagaagacagtggcccctgcagaatgctct

SEQ ID NO: 536 - protein, 106 aa, Homo Sapiens
GQPKAAPSVTLFPPSSEELQANKATLVCLVSDFNPGAVTVAWKADGSPVKVGVETTKPSKQSNNKYAASSYLSLTPEQWKSHRSYSCRVTHEGSTVEKTVAPAECS

SEQ ID NO: 537 - DNA, 990 bp, Homo Sapiens
gcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 538 - protein, 106 aa, Homo Sapiens; identical to SEQ ID NO: 225

SEQ ID NO: 539 - protein, 663 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 215 aa, Homo Sapiens
EVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 541 - protein, 220 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 542 - protein, 667 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 543 - protein, 217 aa, Homo Sapiens
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 544 - protein, 214 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 545 - protein, 663 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 546 - protein, 214 aa, Homo Sapiens
EVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKI

SEQ ID NO: 547 - protein, 220 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 548 - protein, 667 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 549 - protein, 216 aa, Homo Sapiens
EVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKI

SEQ ID NO: 550 - protein, 214 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 551 - protein, 659 aa, Homo Sapiens
DIQMTQSPASLSASLGETVTIQCRASEDIYSGLAWFQQKPGKSPQLLIYGASSLQDGVPSRFSGSGSGTQYSLKISSMQTEDEGVYFCQQGLKYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLTQPGKSLKLSCEASGFTFSSFTMHWVRQSPGKGLEWVAFIRSGSGIVFYADAVRGRFTISRDNAKNLLFLQMNDLKSEDTAMYYCARRPLGHNTFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 552 - protein, 215 aa, Homo Sapiens; identical to SEQ ID NO: 540

SEQ ID NO: 553 - protein, 220 aa, Homo Sapiens; identical to SEQ ID NO: 541

SEQ ID NO: 554 - protein, 663 aa, Homo Sapiens
DIVMTQSPSSLAVSPGEKVTMTCKSSQSLYYSGVKENLLAWYQQKPGQSPKLLIYYASIRFTGVPDRFTGSGSGTDYTLTITSVQAEDMGQYFCQQGINNPLTFGDGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECEVQLVESGGGLVQPGRSLKLSCAASGFTFSDFYMAWVRQAPKKGLEWVASISYEGSSTYYGDSVMGRFTISRDNAKSTLYLQMNSLRSEDTATYYCARQREANWEDWGQGVMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 555 - protein, 217 aa, Homo Sapiens; identical to SEQ ID NO: 543

SEQ ID NO: 556 - protein, 214 aa, Homo Sapiens; identical to SEQ ID NO: 544

SEQ ID NO: 557 - protein, 659 aa, Homo Sapiens; identical to SEQ ID NO: 551

SEQ ID NO: 558 - protein, 215 aa, Homo Sapiens; identical to SEQ ID NO: 540

SEQ ID NO: 559 - protein, 220 aa, Homo Sapiens; identical to SEQ ID NO: 541

SEQ ID NO: 560 - protein, 663 aa, Homo Sapiens; identical to SEQ ID NO: 554

SEQ ID NO: 561 - protein, 217 aa, Homo Sapiens; identical to SEQ ID NO: 543

SEQ ID NO: 562 - protein, 214 aa, Homo Sapiens; identical to SEQ ID NO: 544

SEQ ID NO: 563 - DNA, 364 bp, Homo Sapiens
caggttcaactgatgcagtctggaactgaggtgaagaagcctggggcctcagtgaaggtctcctgcaagacttctggttacacctttaccacctatggtatcacttgggtgcgacaggcccctggacaagggcttgagtggatgggatggatcagcgcttacagtggtgacacagactatgcacagaagttccagggcagagtcaccgtgacaacagacacatccacgaacacagcctacatggagttgaggagcctgaaatctgacgacacggccgtgtattattgtgcgagaagtagtggctggccccaccactacggtatggacgtctggggccaagggaccacggtcaccgtctcctcag

SEQ ID NO: 564 - protein, 121 aa, Homo Sapiens
QVQLMQSGTEVKKPGASVKVSCKTSGYTFTTYGITWVRQAPGQGLEWMGWISAYSGDTDYAQKFQGRVTVTTDTSTNTAYMELRSLKSDDTAVYYCARSSGWPHHYGMDVWGQGTTVTVSS

SEQ ID NO: 565 - protein, 8 aa, Homo Sapiens
GYTFTTYG

SEQ ID NO: 566 - protein, 8 aa, Homo Sapiens
ISAYSGDT

SEQ ID NO: 567 - protein, 14 aa, Homo Sapiens
ARSSGWPHHYGMDV

SEQ ID NO: 568 - DNA, 373 bp, Homo Sapiens
caggttcaactggtgcagtctggaggtgaggtgaaaaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtctccatgaccacagacacatccacgagcacagcctacatggagctgaggagcttgagatctgacgacacggccgtgtatttctgtgcgcgatctacgtcttactatggttcggggaccctatacggtatggacgtctggggccaagggaccacggtcaccgtctcctcag

SEQ ID NO: 569 - protein, 124 aa, Homo Sapiens
QVQLVQSGGEVKKPGASVKVSCKASGYTFTSYGFSWVRQAPGQGLEWMGWISAYNGNTNYAQKLQGRVSMTTDTSTSTAYMELRSLRSDDTAVYFCARSTSYYGSGTLYGMDVWGQGTTVTVSS

SEQ ID NO: 570 - protein, 17 aa, Homo Sapiens
ARSTSYYGSGTLYGMDV

SEQ ID NO: 571 - DNA, 373 bp, Homo Sapiens
caggttcaactggtgcagtctggaggtgaggtgaagaagcctggggcctcagtgaaggtctcctgcaaggcttctggttacacctttaccagctatggtttcagctgggtgcgacaggcccctggacaaggactagagtggatgggatggatcagcgcttacaatggtaacacaaactatgcacagaagctccagggcagagtctccatgaccacagacacatccacgagcacagcctacatggagctgaggagcttgagatctgacgacacggccgtgtattactgtgcgcgatctacgtcttactatggttcggggaccctctacggtatggacgtctggggccaagggaccacggtcaccgtctcctcag

SEQ ID NO: 572 - protein, 124 aa, Homo Sapiens
QVQLVQSGGEVKKPGASVKVSCKASGYTFTSYGFSWVRQAPGQGLEWMGWISAYNGNTNYAQKLQGRVSMTTDTSTSTAYMELRSLRSDDTAVYYCARSTSYYGSGTLYGMDVWGQGTTVTVSS

SEQ ID NO: 573 - DNA, 373 bp, Homo Sapiens; identical to SEQ ID NO: 568

SEQ ID NO: 574 - protein, 124 aa, Homo Sapiens; identical to SEQ ID NO: 569

SEQ ID NO: 575 - DNA, 373 bp, Homo Sapiens
caggttcaactggtgcagtctggaggtgaggtgaaaaagcctcgggcctcagtgaaggtctcctgcaaggcttctggttacacctttaccagctatgtgttcagctgggtgcgacatgccgctggacaaggactagagtggatgggatggatcagcggttacaatggtaacacaaactatgcacagaagctccagtgcggagtctcgatgaccgcagacacatccacgagcacagcctacatggagctgaggagcttgagatctgacgacacggccgtgtatttctgtgcgcgatctacgtcttactatggtgcggggaccctatacggtatggacgtctggggccaagggaccacggtcaccgtctcctcag

SEQ ID NO: 576 - protein, 124 aa, Homo Sapiens
QVQLVQSGGEVKKPRASVKVSCKASGYTFTSYVFSWVRHAAGQGLEWMGWISGYNGNTNYAQKLQCGVSMTADTSTSTAYMELRSLRSDDTAVYFCARSTSYYGAGTLYGMDVWGQGTTVTVSS

SEQ ID NO: 577 - protein, 8 aa, Homo Sapiens
GYTFTSYV

SEQ ID NO: 578 - protein, 8 aa, Homo Sapiens
ISGYNGNT

SEQ ID NO: 579 - protein, 17 aa, Homo Sapiens
ARSTSYYGAGTLYGMDV

SEQ ID NO: 580 - DNA, 373 bp, Homo Sapiens
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtattactgtgcggccgattactatggttcggggagttattataacgtcccctttgactactggggccagggaaccctggtcaccgtctcctcag

SEQ ID NO: 581 - protein, 124 aa, Homo Sapiens
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCAADYYGSGSYYNVPFDYWGQGTLVTVSS

SEQ ID NO: 582 - protein, 8 aa, Homo Sapiens
GFTFDDYG

SEQ ID NO: 583 - protein, 8 aa, Homo Sapiens
INWNGGST

SEQ ID NO: 584 - protein, 17 aa, Homo Sapiens
AADYYGSGSYYNVPFDY

SEQ ID NO: 585 - DNA, 373 bp, Homo Sapiens
gaggtgcagctggtggagtctgggggaggtgtgatacggcctggggggtccctgagactctcctgtgcagcctctggattcacctttgatgattatggcatgagctgggtccgccaagctccagggaaggggctggagtgggtctctggtattaattggattggtgataacacagattatgcagactctgtgaagggccgattcaccatctccagagacaacgccaagaactccctatatctgcaaatgaacagtctgagagccgaggacacggccttgtattactgtgcgagagattactttggttcggggagttattataacgttccctttgactactggggccagggaaccctggtcaccgtctcctcag

SEQ ID NO: 586 - protein, 124 aa, Homo Sapiens
EVQLVESGGGVIRPGGSLRLSCAASGFTFDDYGMSWVRQAPGKGLEWVSGINWIGDNTDYADSVKGRFTISRDNAKNSLYLQMNSLRAEDTALYYCARDYFGSGSYYNVPFDYWGQGTLVTVSS

SEQ ID NO: 587 - protein, 8 aa, Homo Sapiens
INWIGDNT

SEQ ID NO: 588 - protein, 17 aa, Homo Sapiens
ARDYFGSGSYYNVPFDY

SEQ ID NO: 589 - DNA, 337 bp, Homo Sapiens
gatattgtgatgactcagtctccactctccctgcccgtcacccctggagagccggcctccatctcctgcaggtctagtcagagcctcctgcatagtaatggattcaactatttcgattggtacctgcagaagccaggacagtctccacagctcctgatctttttggtttctaatcgggcctccggggtccctgacaggttcagtggcagtggatcaggcacagattttacactgaaaatcagcagagtggaggctgaggatgttgggatttattactgcatgcaagctctacaaactccgctcactttcggcggagggaccaaggtggagatcaaac

SEQ ID NO: 590 - protein, 112 aa, Homo Sapiens
DIVMTQSPLSLPVTPGEPASISCRSSQSLLHSNGFNYFDWYLQKPGQSPQLLIFLVSNRASGVPDRFSGSGSGTDFTLKISRVEAEDVGIYYCMQALQTPLTFGGGTKVEIK

SEQ ID NO: 591 - protein, 11 aa, Homo Sapiens
QSLLHSNGFNY

SEQ ID NO: 592 - protein, 3 aa, Homo Sapiens
LVS

SEQ ID NO: 593 - protein, 9 aa, Homo Sapiens
MQALQTPLT

SEQ ID NO: 594 - DNA, 337 bp, Homo Sapiens
gatattgtgatgactcagtctccactctccctgcccgtcacccctggagagccggcctccatctcctgcaggtctagtcagagcctcctgcatagtaatggatacaactgtttggattggtacctgcagaagccagggcagtctccacagctcctgatctatttgggttctactcgggcctccgggttccctgacaggttcagtggcagtggatcaggcacagattttacactgaaaatcagcagagtggaggctgaggatgttggggtttattactgcatgcaagctctacaaactccgtgcagttttggccaggggaccaagctggagatcaaac

SEQ ID NO: 595 - protein, 112 aa, Homo Sapiens
DIVMTQSPLSLPVTPGEPASISCRSSQSLLHSNGYNCLDWYLQKPGQSPQLLIYLGSTRASGFPDRFSGSGSGTDFTLKISRVEAEDVGVYYCMQALQTPCSFGQGTKLEIK

SEQ ID NO: 596 - protein, 11 aa, Homo Sapiens
QSLLHSNGYNC

SEQ ID NO: 597 - DNA, 337 bp, Homo Sapiens; identical to SEQ ID NO: 594

SEQ ID NO: 598 - protein, 112 aa, Homo Sapiens; identical to SEQ ID NO: 595

SEQ ID NO: 599 - DNA, 337 bp, Homo Sapiens
gatattgtgatgactcagtctccactctccctgcccgtcacccctggagagccggcctccatctcctgcaggtctagtcagagcctcctgcatagtaatggatacaactgtttggattggtacctgcagaagccagggcagtctccacagctcctgatctatttgggttctactcgggcctccgggttccctgacaggttcagtggcagtggatcaggcacagattctacactgaaaatcagcagagtggaggctgaggatgttggggtttattactgcatgcaagctctacaaactccgtgcagttttggccaggggaccaagctggagatcaaac

SEQ ID NO: 600 - protein, 112 aa, Homo Sapiens
DIVMTQSPLSLPVTPGEPASISCRSSQSLLHSNGYNCLDWYLQKPGQSPQLLIYLGSTRASGFPDRFSGSGSGTDSTLKISRVEAEDVGVYYCMQALQTPCSFGQGTKLEIK

SEQ ID NO: 601 - DNA, 337 bp, Homo Sapiens; identical to SEQ ID NO: 594

SEQ ID NO: 602 - protein, 112 aa, Homo Sapiens; identical to SEQ ID NO: 595

SEQ ID NO: 603 - DNA, 325 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctttcactttcggccctgggaccaaagtggatatcaaac

SEQ ID NO: 604 - protein, 108 aa, Homo Sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 605 - protein, 9 aa, Homo Sapiens
QQYGSSPFT

SEQ ID NO: 606 - DNA, 325 bp, Homo Sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaagattttgcagtatattactgtcaccagtatggtaattcaccattcactttcggccctgggaccaaagtggatatcaaac

SEQ ID NO: 607 - protein, 108 aa, Homo Sapiens
EIVLTQSPGTLSLSPGERATLSCRASQSVSSSYLAWYQQKPGQAPRLLIYGASSRATGIPDRFSGSGSGTDFTLTISRLEPEDFAVYYCHQYGNSPFTFGPGTKVDIK

SEQ ID NO: 608 - protein, 9 aa, Homo Sapiens
HQYGNSPFT

SEQ ID NO: 609 - protein, 11 aa, Homo Sapiens
  MISC_FEATURE (1)..(1): Xaa is any amino acid
  MISC_FEATURE (5)..(5): Xaa is any amino acid
  MISC_FEATURE (8)..(8): Xaa is any amino acid
  MISC_FEATURE (9)..(9): Xaa is either present or absent, and if present, may be any amino acid.
XGSGXYGXXFD

SEQ ID NO: 610 - protein, 478 aa, Artificial Sequence
  ICOSL-Fc
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSDIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 611 - protein, 98 aa, Homo Sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 612 - DNA, 1413 bp, Homo Sapiens
atggagtttgggctgagctgggtcttccttgttgctattttaaaaggtgtccagtgtgaggtgcagctggtggagtctgggggaggtgtggtacggcctggggggtccctgagactctcctgtgtagcctctggagtcacctttgatgattatggcatgagctgggtccgccaagctccagggaaggggctggagtgggtctctggtattaattggaatggtggcgacacagattattcagactctgtgaagggccgattcaccatctccagagacaacgccaagaactccctgtatctacaaatgaatagtctgagagccgaggacacggccttgtattactgtgcgagggatttctatggttcggggagttattatcacgttccttttgactactggggccagggaatcctggtcaccgtctcctcagccagcaccaagggcccctctgtgttccctctggccccttccagcaagtccacctctggcggaacagccgctctgggctgcctcgtgaaggactacttccccgagcctgtgaccgtgtcctggaactctggcgctctgaccagcggagtgcacaccttccctgctgtgctgcagtcctccggcctgtactccctgtcctccgtcgtgaccgtgccttccagctctctgggcacccagacctacatctgcaacgtgaaccacaagccctccaacaccaaggtggacaagaaggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacaactccacctaccgggtggtgtccgtgctgaccgtgctgcaccaggattggctgaacggcaaagagtacaagtgcaaggtgtccaacaaggccctgcctgcccccatcgaaaagaccatctccaaggccaagggccagccccgggaaccccaggtgtacacactgccccctagcagggacgagagcgggtactgggtgtccctgacctgtctcgtgaaaggcttctacccctccgatatcgccgtggaatgggagtccaacggcgagcctcagtactgggccaagaccaccccccctgtgctggactccgacggctcattcttcctgtacagcaagctgacagtgagcaactggcggtggcagctggacgacttctcctgctccgtgatgcacgaggccctgcacaaccactacacccagaagtccctgtccctgagccccggcaag

SEQ ID NO: 613 - protein, 110 aa, Artificial Sequence
  Fcab _289 Fc sequence WT and Fcab CH2 sequence
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 614 - DNA, 705 bp, Homo Sapiens
atggaaaccccagcgcaccttctcttcctcctgctactctggctcccagataccaccggagaaattgtgttgacgcagtctccagggaccctgtctttgtctccaggggaaagagccaccctctcctgcagggccagtcagagtgttagcagaagctacttagcctggtaccagcagaaacgtggccaggctcccaggctcctcatctatggtgcatccagcagggccactggcatcccagacaggttcagtggcgatgggtctgggacagacttcactctctccatcagcagactggagcctgaagattttgcagtgtattactgtcaccagtatgatatgtcaccattcactttcggccctgggaccaaagtggatatcaaacgtacggtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaactcccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgt

SEQ ID NO: 615 - protein, 107 aa, Homo Sapiens
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 616 - protein, 105 aa, Artificial Sequence
  Fcab _289 Fc sequence Fcab CH3 sequence
GQPREPQVYTLPPSRDESGYWVSLTCLVKGFYPSDIAVEWESNGEPQYWAKTTPPVLDSDGSFFLYSKLTVSNWRWQLDDFSCSVMHEALHNHYTQKSLSLSPGK

SEQ ID NO: 617 - protein, 4 aa, Artificial Sequence
  Fcab _289 Fc sequence AB loop
SGYW

SEQ ID NO: 618 - protein, 6 aa, Artificial Sequence
  Fcab _289 Fc sequence CD loop
EPQYWA

SEQ ID NO: 619 - protein, 9 aa, Artificial Sequence
  Fcab _289 Fc sequence EF loop
SNWRWQLDD

SEQ ID NO: 620 - protein, 221 aa, Artificial Sequence
  Fcab _289 Fc sequence
TCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDESGYWVSLTCLVKGFYPSDIAVEWESNGEPQYWAKTTPPVLDSDGSFFLYSKLTVSNWRWQLDDFSCSVMHEALHNHYTQKSLSLSPGK

SEQ ID NO: 621 - protein, 452 aa, Homo Sapiens
EVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDESGYWVSLTCLVKGFYPSDIAVEWESNGEPQYWAKTTPPVLDSDGSFFLYSKLTVSNWRWQLDDFSCSVMHEALHNHYTQKSLSLSPGK

SEQ ID NO: 622 - protein, 471 aa, Homo Sapiens
MEFGLSWVFLVAILKGVQCEVQLVESGGGVVRPGGSLRLSCVASGVTFDDYGMSWVRQAPGKGLEWVSGINWNGGDTDYSDSVKGRFTISRDNAKNSLYLQMNSLRAEDTALYYCARDFYGSGSYYHVPFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDESGYWVSLTCLVKGFYPSDIAVEWESNGEPQYWAKTTPPVLDSDGSFFLYSKLTVSNWRWQLDDFSCSVMHEALHNHYTQKSLSLSPGK

SEQ ID NO: 623 - protein, 215 aa, Homo Sapiens; identical to SEQ ID NO: 417

SEQ ID NO: 624 - protein, 235 aa, Homo Sapiens
METPAHLLFLLLLWLPDTTGEIVLTQSPGTLSLSPGERATLSCRASQSVSRSYLAWYQQKRGQAPRLLIYGASSRATGIPDRFSGDGSGTDFTLSISRLEPEDFAVYYCHQYDMSPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

The invention claimed is:

1. A multispecific antibody that binds ICOS and PD-L1 comprising a Fab and an Fc region, wherein the Fab comprises an ICOS binding site and wherein the Fc region comprises a PD-L1 binding site,
   wherein the PD-L1 binding site is provided by a CH3 domain in which residues 14 to 18 are substituted by SGYW (SEQ ID NO: 617), residues 45.1 to 78 are substituted by EPQYWA (SEQ ID NO: 618), and residues 92 to 101 are substituted by SNWRWQLDD (SEQ ID NO: 619).

2. The antibody according to claim 1, wherein the CH3 domain is a human IgG CH3 domain engineered to comprise the PD-L1 binding site.

3. The antibody according to claim 2, wherein the Fc region is a human IgG Fc region comprising the CH3 domain engineered to comprise the PD-L1 binding site.

4. The antibody according to claim 1, wherein the Fc region is effector positive.

5. The antibody according to claim 1, wherein the IgG is human IgG1.

6. The antibody according to claim 1, wherein the amino acid sequence of the CH3 domain is at least 90% identical to SEQ ID NO: 616.

7. The antibody according to claim 6, wherein the CH3 domain comprises amino acid sequence SEQ ID NO: 616.

8. The antibody according to claim 1, wherein the Fc region comprises an amino acid sequence at least 90% identical to SEQ ID NO: 620.

9. The antibody according to claim 8, wherein the Fc region comprises amino acid sequence SEQ ID NO: 620.

10. The antibody according to claim 1, wherein the Fc domain is homodimeric.

11. The antibody according to claim 1, comprising two Fabs, each comprising an ICOS binding site.

12. The antibody according to claim 11, wherein the two Fabs comprise identical VH-VL domain pairs.

13. The antibody according to claim 12, which is homodimeric.

14. The antibody according to claim 1, wherein the ICOS is human ICOS.

15. The antibody according to claim 1, wherein the Fab binds the extracellular domain of human and mouse ICOS with an affinity ($K_D$) of less than 5 nM as determined by surface plasmon resonance.

16. A multispecific antibody that binds ICOS and PD-L1, comprising a Fab and an Fc region, wherein
   the Fab comprises an ICOS binding site comprising a VH domain amino acid sequence at least 90% identical to SEQ ID NO: 408 and a VL domain amino acid sequence at least 90% identical to SEQ ID NO: 415, and wherein
   the Fc region comprises a PD-L1 binding site provided by a CH3 domain in which residues 14 to 18 are substituted by SGYW (SEQ ID NO: 617), residues 45.1 to 78 are substituted by EPQYWA (SEQ ID NO: 618), and residues 92 to 101 are substituted by SNWRWQLDD (SEQ ID NO: 619).

17. The antibody according to claim 16, wherein the Fab comprises a VH domain amino acid sequence at least 95% identical to SEQ ID NO: 408.

18. The antibody according to claim 16, wherein the Fab comprises a VH domain having HCDR1, HCDR2, and HCDR3 sequences wherein
   HCDR1 is SEQ ID NO: 405, optionally comprising a conservative substitution at residue 28;
   HCDR2 is SEQ ID NO: 406, optionally comprising a substitution at residue 59, residue 63 and/or residue 64; and
   HCDR3 is SEQ ID NO: 407, optionally comprising a substitution at residue 108, residue 109 and/or residue 112.

19. The antibody according to claim 18, comprising a VH domain having HCDR1, HCDR2, and HCDR3 sequences wherein HCDR1 is SEQ ID NO: 405, HCDR2 is SEQ ID NO: 406, and HCDR3 is SEQ ID NO: 407.

20. The antibody according to claim 16, wherein the Fab comprises VH domain amino acid sequence SEQ ID NO: 408.

21. The antibody according to claim 16, comprising a VL domain amino acid sequence at least 95% identical to SEQ ID NO: 415.

22. The antibody according to claim 16, wherein the Fab comprises a VL domain having LCDR1, LCDR2, and LCDR3 sequences wherein
   LCDR1 is SEQ ID NO: 412, optionally comprising a substitution at residue 36,
   LCDR2 is SEQ ID NO: 413, and
   LCDR3 is the SEQ ID NO 414, optionally comprising a substitution at residue 108 or residue 109.

23. The antibody according to claim 22, comprising a VL domain having LCDR1, LCDR2, and LCDR3 sequences wherein LCDR1 is SEQ ID NO: 412, LCDR2 is SEQ ID NO: 413, and LCDR3 is the SEQ ID NO: 414.

24. The antibody according to claim 16, comprising a VL domain amino acid sequence SEQ ID NO: 415.

25. A multispecific antibody comprising a Fab and an Fc region,
   wherein the Fab comprises an ICOS binding site
   wherein the Fc region comprises a PD-L1 binding site, wherein the PD-L1 binding site is provided by a CH3 domain in which residues 14 to 18 are substituted by SGYW (SEQ ID NO: 617), residues 45.1 to 78 are substituted by EPQYWA (SEQ ID NO: 618), and residues 92 to 101 are substituted by SNWRWQLDD (SEQ ID NO: 619), and
   wherein the multispecific antibody comprises a heavy chain comprising amino acid sequence SEQ ID NO: 621.

26. The antibody according to claim 25, comprising a light chain comprising amino acid sequence SEQ ID NO: 623.

27. The antibody according to claim 26, comprising two heavy-light chain pairs, in which the heavy chain comprises amino acid sequence SEQ ID NO: 621 and the light chain comprises amino acid sequence SEQ ID NO: 623.

\* \* \* \* \*